US009878046B2

(12) United States Patent
Shepard et al.

(10) Patent No.: US 9,878,046 B2
(45) Date of Patent: Jan. 30, 2018

(54) ADVERSE SIDE-EFFECTS ASSOCIATED WITH ADMINISTRATION OF AN ANTI-HYALURONAN AGENT AND METHODS FOR AMELIORATING OR PREVENTING THE SIDE-EFFECTS

(75) Inventors: Harold Michael Shepard, San Diego, CA (US); Curtis Thompson, Encinitas, CA (US); Xiaoming Li, San Diego, CA (US); Gregory I. Frost, Del Mar, CA (US)

(73) Assignee: Halozyme, Inc., San Diego, CA (US)

( * ) Notice: Subject to any disclaimer, the term of this patent is extended or adjusted under 35 U.S.C. 154(b) by 0 days.

(21) Appl. No.: 13/135,817

(22) Filed: Jul. 15, 2011

(65) Prior Publication Data
US 2012/0020951 A1 Jan. 26, 2012

Related U.S. Application Data

(60) Provisional application No. 61/399,993, filed on Jul. 20, 2010, provisional application No. 61/455,260, filed on Oct. 14, 2010.

(51) Int. Cl.
*A61K 31/573* (2006.01)
*A61K 47/48* (2006.01)
*A61K 31/37* (2006.01)
*A61K 31/42* (2006.01)
*A61K 38/47* (2006.01)
*A61K 9/00* (2006.01)
*A61K 47/60* (2017.01)

(52) U.S. Cl.
CPC ...... *A61K 47/48215* (2013.01); *A61K 9/0019* (2013.01); *A61K 9/0053* (2013.01); *A61K 31/37* (2013.01); *A61K 31/42* (2013.01); *A61K 31/573* (2013.01); *A61K 38/47* (2013.01); *A61K 47/60* (2017.08); *C12Y 302/01035* (2013.01)

(58) Field of Classification Search
None
See application file for complete search history.

(56) References Cited

U.S. PATENT DOCUMENTS

| 2,488,564 | A | 11/1949 | Singher et al. | 435/201 |
| 2,488,565 | A | 11/1949 | Singher et al. | 435/201 |
| 2,676,139 | A | 4/1954 | Tint et al. | 424/201 |
| 2,795,529 | A | 6/1957 | Album et al. | 424/94.3 |
| 2,806,815 | A | 9/1957 | Singher et al. | 435/188 |
| 2,808,362 | A | 10/1957 | Thompson et al. | 435/201 |
| 3,539,794 | A | 11/1970 | Raunut et al. | 632/34 |
| 4,002,531 | A | 1/1977 | Royer | 435/188 |
| 4,179,337 | A | 12/1979 | Davis et al. | 435/181 |
| 4,952,496 | A | 8/1990 | Studier et al. | 435/91.41 |
| 5,033,252 | A | 7/1991 | Carter | 53/425 |
| 5,052,558 | A | 10/1991 | Carter | 206/439 |
| 5,122,614 | A | 6/1992 | Zalipsky | 548/520 |
| 5,171,081 | A | 12/1992 | Pita et al. | 362/34 |
| 5,323,907 | A | 6/1994 | Kalvelage | 206/531 |
| 5,324,844 | A | 6/1994 | Zalipsky | 548/520 |
| 5,446,090 | A | 8/1995 | Harris | 525/54.1 |
| 5,612,460 | A | 3/1997 | Zalipsky | 530/390.1 |
| 5,643,575 | A | 7/1997 | Martinez et al. | 424/194.1 |
| 5,672,662 | A | 9/1997 | Harris et al. | 525/408 |
| 5,747,027 | A | 5/1998 | Stem et al. | 424/94.62 |
| 5,766,581 | A | 6/1998 | Bartley et al. | 424/85.1 |
| 5,795,569 | A | 8/1998 | Bartley et al. | 424/85.1 |
| 5,808,096 | A | 9/1998 | Zalipsky | 548/520 |
| 5,827,721 | A | 10/1998 | Stem et al. | 435/201 |
| 5,900,461 | A | 5/1999 | Harris | 525/54.11 |
| 5,919,455 | A | 7/1999 | Greenwald et al. | 424/178.1 |
| 5,932,462 | A | 8/1999 | Harris et al. | 435/188 |
| 5,985,263 | A | 11/1999 | Lee et al. | 424/85.2 |
| 5,990,237 | A | 11/1999 | Bentley et al. | 525/54.2 |
| 6,054,569 | A | 4/2000 | Benett et al. | 536/23.2 |
| 6,113,906 | A | 9/2000 | Greenwald et al. | 424/194.1 |
| 6,214,966 | B1 | 4/2001 | Harris | 528/322 |
| 6,258,351 | B1 | 7/2001 | Harris | 424/78.3 |
| 6,340,742 | B1 | 1/2002 | Burg et al. | 530/351 |

(Continued)

FOREIGN PATENT DOCUMENTS

| EP | 0400472 | 12/1990 |
| EP | 0822199 | 9/2004 |

(Continued)

OTHER PUBLICATIONS

CM Kumar, TC Dowd, C Dodds and R Boyce, Orbital swelling following peribulbar and sub-Tenon's anaesthesia, 2004, Eye, vol. 18, pp. 418-420.*
Adrian M. Senderowicz, Information Needed to Conduct First-in-Human Oncology Trials in the United States: A View from a Former FDA Medical Reviewer, Clin. Cancer Res., 2010;vol. 16:pp. 1719-1725. Published OnlineFirst Mar. 9, 2010.*
The NPL document 'American Pharmaceutical Partners dexamethasone solution' is a pdf of the webpage at https://www.mooremedical.com/index.cfm?/Dexamethasone-Sodium-Phosphate-Injection/&PG=CTL&CS=HOM&FN=ProductDetail&PID=22258&spx=1 accessed Nov. 13, 2013.*

(Continued)

*Primary Examiner* — Renee Claytor
*Assistant Examiner* — Trent Clarke
(74) *Attorney, Agent, or Firm* — Dentons US LLP; Stephanie Seidman

(57) ABSTRACT

Provided herein are methods for ameliorating an adverse effect of systemic administration of a PEG hyaluronan degrading enzyme to a subject. The methods involve systemically administering a PEGylated hyaluronan degrading enzyme, particularly a PEGylated hyaluronidase, such as any of the animal or bacterial hyaluronidases, to the subject and administering an amount of a corticosteroid sufficient to ameliorate the adverse effect. Also provided are method of treating a hyaluronan-associated disease or condition for single-agent therapy or combination therapy.

68 Claims, No Drawings

(56) References Cited

U.S. PATENT DOCUMENTS

| | | | |
|---|---|---|---|
| 6,413,507 B1 | 7/2002 | Bentley et al. | 424/78.02 |
| 6,420,339 B1 | 7/2002 | Gegg et al. | 514/5.8 |
| 6,437,025 B1 | 8/2002 | Harris et al. | 523/406 |
| 6,448,369 B1 | 9/2002 | Bentley et al. | 528/425 |
| 6,461,802 B1 | 10/2002 | Van Thillo et al. | 430/336 |
| 6,495,659 B2 | 12/2002 | Bentley et al. | 528/425 |
| 6,737,505 B2 | 5/2004 | Bentley et al. | 528/425 |
| 6,828,401 B2 | 12/2004 | Nho et al. | 526/333 |
| 6,858,736 B2 | 2/2005 | Nho et al. | 546/290 |
| 7,105,330 B2 | 9/2006 | Stern et al. | 435/200 |
| 7,767,429 B2 | 8/2010 | Bookbinder et al. | 435/201 |
| 7,781,397 B2 | 8/2010 | Stem et al. | 424/94.62 |
| 7,829,081 B2 | 8/2010 | Bookbinder et al. | 424/94.62 |
| 7,846,431 B2 | 12/2010 | Bookbinder et al. | 424/94.62 |
| 7,871,607 B2 | 1/2011 | Bookbinder et al. | 424/94.62 |
| 8,105,586 B2 | 1/2012 | Bookbinder et al. | 424/94.3 |
| 8,187,855 B2 | 5/2012 | Baker et al. | 435/201 |
| 8,257,699 B2 | 9/2012 | Bookbinder et al. | 424/94.62 |
| 8,318,154 B2 | 11/2012 | Frost et al. | 424/94.5 |
| 8,343,487 B2 | 1/2013 | Baker et al. | 424/94.62 |
| 8,431,124 B2 | 4/2013 | Bookbinder | 424/94.62 |
| 8,431,380 B2 | 4/2013 | Bookbinder | 435/201 |
| 8,450,470 B2 | 5/2013 | Bookbinder et al. | 536/23.2 |
| 8,580,252 B2 | 11/2013 | Bookbinder et al. | 424/85.2 |
| 8,765,685 B2 | 7/2014 | Bookbinder et al. | 514/20.9 |
| 8,772,246 B2 | 7/2014 | Bookbinder et al. | 435/200 |
| 8,846,034 B2 | 9/2014 | Jiang et al. | 424/94.62 |
| 9,211,315 B2 | 12/2015 | Bookbinder et al. | 424/94.62 |
| 2001/0021763 A1 | 9/2001 | Harris | 528/75 |
| 2001/0044526 A1 | 11/2001 | Shen | 530/409 |
| 2001/0046481 A1 | 11/2001 | Bentley et al. | 424/78.18 |
| 2002/0052430 A1 | 5/2002 | Harris et al. | 523/406 |
| 2002/0072573 A1 | 6/2002 | Bentley et al. | 525/409 |
| 2002/0156047 A1 | 10/2002 | Zhao | 514/58 |
| 2003/0114647 A1 | 6/2003 | Harris et al. | 530/402 |
| 2003/0143596 A1 | 7/2003 | Bentley et al. | 435/6 |
| 2003/0158333 A1 | 8/2003 | Roberts et al. | 530/402 |
| 2003/0190360 A1* | 10/2003 | Baichwal | A61K 9/2813 424/470 |
| 2003/0220447 A1 | 11/2003 | Harris | 528/322 |
| 2004/0013637 A1 | 1/2004 | Bentley et al. | 424/78.17 |
| 2004/0235734 A1 | 11/2004 | Bossard et al. | 530/383 |
| 2004/0268425 A1 | 12/2004 | Bookbinder et al. | 800/18 |
| 2005/0114037 A1 | 5/2005 | Desjarlais et al. | 702/19 |
| 2005/0171328 A1 | 8/2005 | Harris | 528/322 |
| 2005/0209416 A1 | 9/2005 | Harris | 525/523 |
| 2005/0260186 A1 | 11/2005 | Bookbinder et al. | 424/94.61 |
| 2005/0287134 A1 | 12/2005 | Klein | 424/94.61 |
| 2006/0104968 A1 | 5/2006 | Bookbinder et al. | 424/94.61 |
| 2007/0286876 A1 | 12/2007 | Brown et al. | 530/388.26 |
| 2009/0123367 A1 | 5/2009 | Bookbinder et al. | 424/1.49 |
| 2009/0181013 A1 | 7/2009 | Bookbinder et al. | 424/130.1 |
| 2009/0181032 A1 | 7/2009 | Bookbinder et al. | 424/141.1 |
| 2009/0214505 A1 | 8/2009 | Bookbinder et al. | 424/94.1 |
| 2009/0253175 A1 | 10/2009 | Bookbinder et al. | 435/69.1 |
| 2009/0304665 A1 | 12/2009 | Frost et al. | 424/94.5 |
| 2009/0311237 A1 | 12/2009 | Frost et al. | 424/94.62 |
| 2010/0003237 A1 | 1/2010 | Keller et al. | 424/94.62 |
| 2010/0003238 A1 | 1/2010 | Frost et al. | 424/94.62 |
| 2010/0015698 A1 | 1/2010 | Frost et al. | 424/200 |
| 2010/0074885 A1 | 3/2010 | Schiff et al. | 424/130.1 |
| 2010/0143457 A1 | 6/2010 | Wei et al. | 424/450 |
| 2010/0172892 A1 | 7/2010 | Uvarkina et al. | 424/94.62 |
| 2010/0184845 A1 | 7/2010 | Frost et al. | 424/85.2 |
| 2010/0284995 A1 | 11/2010 | Bookbinder et al. | 424/94.62 |
| 2011/0008309 A1 | 1/2011 | Bookbinder et al. | 424/94.62 |
| 2011/0053247 A1 | 3/2011 | Baker et al. | 435/201 |
| 2011/0152359 A1 | 6/2011 | Bookbinder et al. | 435/200 |
| 2011/0212074 A1 | 9/2011 | Frost et al. | 424/85.1 |
| 2012/0093770 A1 | 4/2012 | Bookbinder et al. | 424/94.62 |
| 2012/0148555 A1 | 6/2012 | Bookbinder et al. | 435/200 |
| 2012/0171153 A1 | 7/2012 | Frost et al. | 424/94.62 |
| 2012/0196348 A1 | 8/2012 | Baker et al. | 424/94.62 |
| 2012/0213767 A1 | 8/2012 | Wei et al. | 424/450 |
| 2012/0251620 A1 | 10/2012 | Bookbinder et al. | 424/450 |
| 2012/0294830 A1 | 11/2012 | Bookbinder et al. | 424/85.2 |
| 2013/0058893 A1 | 3/2013 | Bookbinder et al. | 435/200 |
| 2013/0202583 A1 | 8/2013 | Jiang et al. | 424/94.62 |
| 2013/0251786 A1 | 9/2013 | Li et al. | 424/94.62 |
| 2013/0302275 A1 | 11/2013 | Wei et al. | 424/94.62 |
| 2013/0302400 A1 | 11/2013 | Maneval et al. | 435/195 |
| 2014/0037613 A1 | 2/2014 | Bookbinder et al. | 424/94.62 |
| 2014/0105824 A1 | 4/2014 | Shepard et al. | 424/9.2 |
| 2014/0135682 A1 | 5/2014 | Frost et al. | 424/94.5 |
| 2014/0199282 A1 | 7/2014 | Bookbinder et al. | 435/200 |
| 2014/0248237 A1 | 9/2014 | Bookbinder et al. | 424/94.62 |
| 2014/0348817 A1 | 11/2014 | Jiang et al. | 424/94.62 |
| 2015/0010529 A1 | 1/2015 | Wei | 424/94.62 |
| 2016/0220690 A1 | 8/2016 | Shepard et al. | 424/94.62 |

FOREIGN PATENT DOCUMENTS

| | | |
|---|---|---|
| EP | 1064951 | 8/2007 |
| JP | 2013-540103 A | 10/2013 |
| JP | 2016-106099 | 1/2016 |
| WO | WO 1988/02261 | 4/1988 |
| WO | WO 1994/28024 | 12/1994 |
| WO | WO 1999/029841 | 6/1999 |
| WO | WO 2000/02017 | 1/2000 |
| WO | WO 2001/87925 | 4/2001 |
| WO | WO 2001/76640 | 10/2001 |
| WO | WO 2002/49673 | 6/2002 |
| WO | WO 02053137 A2 * | 7/2002 |
| WO | WO 2005/000360 | 1/2005 |
| WO | WO 2005/118799 | 12/2005 |
| WO | WO 2006091871 A1 * | 8/2006 |
| WO | WO 2009037566 A2 * | 3/2009 |
| WO | WO 2009/111066 | 9/2009 |
| WO | WO 2009/128917 | 10/2009 |
| WO | WO 2012/012300 | 1/2012 |

OTHER PUBLICATIONS

K.S. Girish, K. Kemparaju, The magic glue hyaluronan and its eraser hyaluronidase: A biological overview, 2007, Life Sciences, vol. 80, pp. 1921-1943.*

NPL pdf document "WebMD Inflammation", a screenprint of webpage http://www.webmd.com/arthritis/about-inflammation online since Feb. 1, 2001, accessed Aug. 1, 2014.*

NPL pdf document "Chemocare", a screenprint of webpage http://chemocare.com/chemotherapy/drug-info/dexamethasone.aspx online since Apr. 3, 2004, accessed Aug. 3, 2014.*

Robert Stern, Hyaluronidases in cancer biology, 2008, Seminars in Cancer Biology, vol. 18, pp. 275-280.*

Melamed et al., Journal of Allergy and Clinical Immunology, vol. 121 No. 2, Suppl.I, Feb. 2008 (Feb. 2008), p. S83, presented at the 64th Annual Am. Acad. Allergy Asthma Immunol., Philadelphia, PA, Mar. 14-18, 2008, abstract, 1 page.*

Huang et al., Recombinant Human Hyaluronidase PH20 Does Not Stimulate an Acute Inflammatory Response and Inhibits Lipopolysaccharide-Induced Neutrophil Recruitment in the Air Pouch Model of Inflammation, J. Immunol., vol. 192, pp. 5285-5295.*

Document "CTC Version 2.0" published Apr. 30, 1999 by the Department of Health and Human Services, National Institutes of Health, National Cancer Institute, Division of Cancer Treatment and Diagnosis, Cancer Therapy Evaluation Program, accessed at http://ctep.cancer.gov/protocolDevelopment/electronic_applications/docs/ctcy20_4-30-992.pdf on Jun. 22, 2016.*

Halozyme Therapeutics, "Hylenex(R) recombinant (hyaluronidase human injection) and infiltration and extravasion," [online][retrieved on Apr. 3, 2013] Retrieved from:<URL:hylenex.com/files/resources_docs/Infiltration-Extravasation/documentation/Hylenex%20recombinant%20and%20Infiltration-Extravasation.pdf, 7 pages.

Halozyme, Inc. Information and Consent Form, "A Phase 2, Randomized, Multicenter Study of PEGPH20 (PEGylated Recombinant Human Hyaluronidase) Combined with nab-Paclitaxel Plus Gemcitabine Compared with nab-Paclitaxel Plus Gemcitabine in Subjects with Stage IV Previously Untreated pancreatic Cancer," Study # HALO-109-202. Approved Feb. 14, 2013, 1 page.

(56) References Cited

OTHER PUBLICATIONS

Jacobetz et al., "Hyaluronan impairs vascular function and drug delivery in a mouse model of pancreatic cancer," Gut. 62(1):112-120 (2013).
Jiang et al., "Effective targeting of the tumor microenvironment for cancer therapy," Anticancer Research 32:1203-1212 (2012).
Kultti et al., "Therapeutic targeting of hyaluronan in the tumor stroma," Cancers. 4(3):873-903 (2012).
Provenzano et al., "Enzymatic targeting of the stroma ablates physical barriers to treatment of pancreatic ductal adenocarcinoma," Cancer Cell. 21(3):418-429 (2012).
Frost, G., "Halozyme Therapeutics, Inc. Thinking outside the cell," presented at J. P. Morgan Healthcare Conference on Jan. 10, 2013. Presentation. 23 pages.
Halozyme Therapeutics, J.P. Morgan Annual Healthcare Conference Presentation, Jan. 2013. Presentation, 18 pages.
Harris et al., "Pharmacokinetic (PK)/pharmacodynamic (PD) results from a phase Ib study of pegylated hyaluronidase PH20 (PEGPH20) in combination with gemcitabine (Gem) in patients with pancreatic cancer," 2013 ASCO Annual Meeting, J Clin Oncol 31, 2013 (suppl; abstr e15005) Available online May 15, 2013, 3 pages.
Hingorani et al., "A phase Ib study of gemcitabine plus PEGPH20 (pegylated recombinant human hyaluronidase) in patients with stage IV previously untreated pancreatic cancer," 2013 ASCO Annual Meeting, J Clin Oncol 31, 2013 (suppl; abstr 4010) Epub date May 15, 2013, 3 pages.
Hingorani et al., "A phase Ib study of gemcitabine plus PEGPH20 (pegylated recombinant human hyaluronidase) in patients with stage IV previously untreated pancreatic cancer," 2013 ASCO Annual Meeting, Chicago, IL, Poster #4010, 1 page.
Jiang et al., "Phase 1 pharmacodynamic activity of multiple-dose PEGylated hyaluronidase PH20 (PEGPH20) in patients with solid tumors," AACR Annual Meeting 2013 Apr. 6-10, 2013, Washington, D.C., Abstract 3375, [Retrieved from the internet Apr. 5, 2013], 1 page.
Jiang et al., "Phase 1 pharmacodynamic activity of multiple-dose PEGylated hyaluronidase PH20 (PEGPH20) in patients with solid tumors," AACR Annual Meeting 2013 Apr. 6-10, 2013, Washington, D.C., Poster 3375, 1 page.
Osgood et al., "Pegylated recombinant human hyaluronidase PH20 (PEGPH20) enhances Nab-Paclitaxel efficacy in BxPC-3 human pancreatic cancer xenografts," Cancer Research 72(8):Suppl 1 (2012), 2 pages.
Singha et al., "Hyaluronan-rich ECM contributes to resistance to antibody-dependent cell-mediated cytotoxicity in solid tumors," AACR Annual Meeting 2013 Apr. 6-10, 2013, Washington, D.C., Abstract #4999 [Retrieved from the internet Apr. 5, 2013], 1 page.
Singha et al., "Hyaluronan-rich ECM contributes to resistance to antibody-dependent cell-mediated cytotoxicity in solid tumors," AACR Annual Meeting 2013 Apr. 6-10, 2013, Washington, D.C., Poster #4999, 1 page.
Thompson et al., "Pegylated recombinant human hyaluronidase PH20 (PEGPH20) increases tumor perfusion in mouse xenografts and phase 1 cancer patients," AACR Annual Meeting 2013 Apr. 6-10, 2013, Washington, D.C., Abstract #4955 [Retrieved from the internet Apr. 5, 2013], 1 page.
Thompson et al., "Pegylated recombinant human hyaluronidase PH20 (PEGPH20) increases tumor perfusion in mouse xenografts and phase 1 cancer patients," AACR Annual Meeting 2013 Apr. 6-10, 2013, Washington, D.C., Poster #4955, 1 page.
Thompson et al., "Pegylated recombinant human hyaluronidase PH20 (PEGPH120) reduces 18FDG-PET uptake in mouse xenografts and phase 1 cancer patients," Society of Nuclear Medicine and Molecular Imaging (SNMMI) 2013 Mid-Winter Meeting, Jan. 23-27, 2013, New Orleans, LA. Abstract, 1 page.
Thompson et al., "Pegylated recombinant human hyaluronidase PH20 (PEGPH20) reduces 18FDG-PET uptake in mouse xenografts and phase 1 cancer patients," Society of Nuclear Medicine and Molecular Imaging (SNMMI) 2013 Mid-Winter Meeting, Jan. 23-27, 2013, New Orleans, LA. Poster #73, 1 page.
Halozyme Therapeutics Investor Presentation, "Halozyme Therapeutics, Inc.: Thinking outside the cell," Presented on Oct. 2, 2012 [online][retrieved on Oct. 11, 2012] Retrieved from:<URL:sec.gov/Archives/edgar/data/1159036/000119312512412748/d419091dex991.htm [82 pages].
News Release, "Halozyme's pegylated enzyme found to be effective in preclinical studies," Published on-line Jul. 24, 2008 at http://inwardinvestment.pharmaceutical-business-review.com/news/a849fhalozymes_pegylated_enzyme_found_to_be_effective_in_preclinical_st (accessed Jun. 12, 2013), 2 pages.
News Release, "Halozyme's phase 1b clinical trial of PEGPH20 with Gemcitabine indicates positive activity against pancreatic cancer," Published on-line Jun. 3, 2013 and Retrieved from:<URL:firstwordpharma.com/node/1098370?tsid=4 (accessed Jun. 12, 2013), 3 pages.
News Release, Halozyme Therapeutics Inc. "Halozyme Therapeutics' CEO discusses Q4 2012 results—earnings call transcript," Published on-line Feb. 25, 2013 at http://seekingalpha.com/article/1222991-halozyme-therapeutics-ceo-discusses-q4-2012-results-earnings-call-transcript?part=single [accessed Jun. 12, 2013][16 pages].
News Release, "Halozyme Therapeutics and Pfizer enter into a collaboration to develop and commercialize subcutaneous biologics using recombinant human hyaluronidase," Published on Dec. 21, 2012 [online} [Retrieved on Jan. 3, 2013] Retrieved from:<URL:halozyme.com/Investors/News-Releases/News-Release-Details/2012/Halozyme-Therapeutics-And-Pfizer-Enter-Into-A-Collaboration-To-Develop-And-Commercialize-Subcutaneous-Biologics-Using-Recombi/default.aspx, 2 pages.
Transcript, "Halozyme Therapeutics's CEO hosts analyst/investor day conference call (Transcript)," Published on Oct. 2, 2012 [online][retrieved on Oct. 25, 2012] Retrieved from:<URL:seekingalpha.com/article/901141-halozyme-therapeutics-s-ceo-hosts-analyst-investor-day-conference-call-transcript?part=single [49 pages].
News Release, "Halozyme Therapeutics to present at the 31st Annual J.P. Morgan Healthcare Conference," Published Jan. 3, 2013 [online][Retrieved Jan. 17, 2013][Retrieved from :<URL: halozyme.com/Investors/News-Releases/News-Release-Details/2013/Halozyme-Therapeutics-to-Present-at-the-31st-Annual -JP-Morgan-Healthcare-Conference1132508/default.aspx, 2 pages.
News Release, "Halozyme begins randomized, controlled clinical trial with PEGPH20 in patients with advanced pancreatic cancer," Published Oct. 5, 2011 [online][Retrieved May 30, 2013][Retrieved from:<URL:halozyme.com/Investors/News-Releases/News-Release-Details/2011/Halozyme-Begins-Randomized-Controlled-Clinical-Trial-with-PEGPH20-in-Patients-with-Advanced-Pancreatic-Cancer1126802/default.aspx, 1 page.
News Release, "Halozyme Initiates Randomized Phase 2 Trial of PEGPH20 in Pancreatic Cancer," Published Apr. 23, 2013 [online][Retrieved May 16, 2013] Retrieved from the Internet: URL: http://www.halozyme.com/Investors/News-Releases/News-Release-Details/2013/Halozyme-Initiates-Randomized-Phase-2-Trial-of-PEGPH20-in-Pancreatic-Cancer/default.aspx, 1 page.
News Release, Halozyme to present new data on PEGPH20 in pancreatic cancer at American Society of Clinical Oncology Annual Meeting, Published May 15, 2013 [online][Retreived May 16, 2013] Retrieved from:<URL:halozyme.com/Investors/News-Releases/News-Release-Details/2013/Halozyme-To-Present-New-Data-On-PEGPH20-In-Pancreatic-Cancer-At-American-Society-of-Clinical-Oncology-Annual-Meeting/default.aspx, 3 pages.
International Preliminary Report on Patentability, dated Oct. 25, 2012, in connection with International Patent Application No. PCT/US2011/044281, 16 pages.
Bordier C., "Phase separation of integral membrane proteins in Triton X-114 solution," J Biol Chem. 256(4):1604-1607 (1981).
Brinster et al., "Regulation of metallothionein—thymidine kinase fusion plasmids injected into mouse eggs," Nature 296:39-42 (1982).
Carrillo, H. and D. Lipman, "The multiple-sequence alignment problem in biology," SIAM J Applied Math 48:1073-1082 (1988).
Eisenhaber et al., "Prediction of potential GPI-modification sites in proprotein sequences," J. Mol. Biol. 292(3):741-758 (1999).

(56) References Cited

OTHER PUBLICATIONS

Fankhauser, N. and P. Mäser, "Identification of GPI anchor attachment signals by a Kohonen self-organizing map," Bioinformatics 21(9):1846-1852 (2005).
Omaetxebarria et al., "Computational approach for identification and characterization of GPI-anchored peptides in proteomics experiments," Proteomics 7(12):1951-1960 (2007).
Ozerdem, U. and A. Hargens, "A simple method for measuring interstitial fluid pressure in cancer tissues," Microvasc. Res. 70:116-120 (2005).
Pierleoni et al., PredGPI: a GPI-anchor predictor, BMC Bioinformatics 9:392, 11 pages (2008).
Toole, B., "Proteoglycans and hyaluronan in morphogenesis and differentiation," in *Cell Biol. Extracell. Matrix*, Hay (ed), Plenum Press:New York pp. 305-341 (1991).
Udenfriend, S. and K. Kodukula, "Prediction of omega site in nascent precursor of glycosylphosphatidylinositol protein," Methods Enzymol. 250:571-582 (1995).
Borad et al., "Targeting hyaluronan (HA) in tumor stroma: a phase I study to evaluate the safety, pharmacokinetics (PK), and pharmacodynamics (PD) of pegylated hyaluronidase (PEGPH20) in Patients with solid tumors," 2012 ASCO Annual Meeting, Jun. 1-5, 2012 Chicago, IL. Abstract 2579. [Published on-line May 16, 2012], 3 pages.
Borad et al., "Targeting hyaluronan (HA) in tumor stroma: a phase I study to evaluate the safety, pharmacokinetics (PK), and pharmacodynamics (PD) of pegylated hyaluronidase (PEGPH20) in Patients with solid tumors," 2012 ASCO Annual Meeting, Jun. 1-5, 2012 Chicago, IL. Poster 2579, 1 page.
Response to Written Opinion, dated Jan. 25, 2012, in connection with corresponding International Application No. PCT/US2011/044281, 53 pages.
Second Written Opinion, dated Jul. 16, 2012 in connection with corresponding International Patent Application No. PCT/US2011/044281, 12 pages.
Response to Second Written Opinion, dated Jul. 16, 2012 in connection with corresponding International Patent Application No. PCT/US2011/044281, 17 pages.
Anttila et al., "High levels of stromal hyaluronan predict poor disease outcome in epithelial ovarian cancer," Cancer Rearch 60:150-155 (2000).
Bioworld Today, "AACR Roundup," by Trista Morrison featuring Halozyme Therapeutics and PEGPH20, 20(75):8 (2009).
Bookbinder et al., "A Recombinant huFman enzyme for enhanced interstitial transport of therapeutics," J Control Release 114:230-241 (2006).
Cheng et al., "Poly(ethylene glycol) modification of beta-glucuronidase-antibody conjugates for solid-tumor by targeted activation of glucuronide prodrugs," Cancer Immunology Immunother, 44(6):305-315 (1997).
Cherr et al., "The dual functions of GPI-anchored PH-20: hyaluronidase and intracellular signaling," Matrix Biol. 20:515-525 (2001).
Clinical Trial: "Safety Study of PEGPH20 Given to Patients with Advanced Solid Tumors" found at: www.clinicaltrials.gov/ct2/show/NCT00834704?term=PEGPH20&rank=1 [assessed Jul. 27, 2010; first received Jan. 29, 2009] [4 pages].
Clinical Trial: "Study of PEGPH20 with Initial Dexamethasone Premedication Given Intravenously to Patients with Advanced Solid Tumors" found at: www.clinicaltrials.gov/ct2/show?term=PEGPH20&rank=2 [accessed Jul. 27, 2010; first received Jul. 26, 2010] [4 pages].
Clinical Trials.gov "HALO-109-102 Study of PEGPH20 with Dexamethasone (PEG2)" (accessed May 2, 2011), 1 page.
Csoka et al., "Hyaluronidases in tissue invasion," Invasion Metastasis 17:297-311 (1997).
Csoka et al., "Purification and microsequencing of hyaluronidase isozymes from human urine," FEBS Lett., 417(3):307-310 (1997).
Csoka et al., "The six hyaluronidase-like genes in the human and mouse genomes," Matrix Biol. 20:499-508 (2001).

Egberts et al. "Dexamethasone reduces tumor recurrence and metastasis after pancreatic tumor resection in SCID mice," Cancer Biol Ther 7(7):1044-1050 (2008).
Frost et al., "HYALILUCA-1, a candidate tumor suppressor gene on chromosome 3p21.3, is inactivated in head and neck squamous cell carcinomas by aberrant splicing of pre-mRNA," Oncogene, 19:870-877 (2000).
Frost et al., "Purification, cloning, and expression of human plasma hyaluronidase," Biochem. Biophys. Res. Commun. 236:10-15 (1997).
Haller et al., "Escaping the interstitial matrix with enzyme-mediated drug delivery," Drug Delivery Technology, 5(5):1-6 (2005).
Haller, M., "Converting intravenous dosing to subcutaneous dosing with recombinant human hyaluronidase," Pharmaceut Tech., Oct. 2007 Newsletter, 14 pgs.
Halozyme Therapeutics Clinical Trial Informed Consent Form, "A Phase 1, multicenter, open-label, dose escalation, safety, tolerability, pharmacokinetic and pharmacodynamic study of PEGPH20 (PEGylated recombinant human hyaluronidase) with intitial dexamethasone premedication given intravenously to patients with advanced solid tumors." Signed Jul. 16, 2010, 13 pages.
Jevsevar et al., "PEGylation of therapeutic proteins," Biotechnol J. 5:113-128 (2010).
Kendall, P., "The use of hydrocortisone by local injection," Ann Phys Med. 3(1):1-8 (1956).
Kozak et al., "The effect of recombinant human hyaluronidase on dexamethasone penetration into the posterior segment of the eye after sub-tenon's injection," Journal of Ocular Pharmacology and Therapeutics, 22(5):362-369 (2006).
Kudawara et al., "In vivo inhibition of tumour growth by dexamethasone." European Journal of Cancer, 37:1703-1708 (2001).
Matousek et al., "Effect of hyaluronidase and PEG chain conjugation on the biologic and antitumor activity of RNase A," J Control Release 94(2-3):401-410 (2004).
Nadjsombati et al., "Dose-range developmental toxicity of rHuPH20 in mice," Matrix Biology 27:23(2008).
Oncolology—Halozyme Therapeutics, retrieved from: www.halozyme.com/products_oncology.php [3 pages] [accessed on Jan. 21, 2010].
Shekhar et al., "The matrix reloaded: halozyme's recombinant enzyme helps injected drugs spread faster," Chem. Biol. 14:603-604 (2007).
Singh et al., "Efficacy of hydrocortisone acetate/hyaluronidase vs triamcinolone acetonide/hyaluronidase in the treatment of oral submucous fibrosis," Indian J Med Res. 131:665-669 (2010).
Stem, R., "Devising a pathway for hyaluronan catabolism: are we there yet?" Glycobiology 13:105R-115R (2003).
Stuhlmeier et al. "Glucocorticoids inhibit induced and non-induced mRNA accumulation of genes encoding hyaluronan synthases (HAS): hydrocortisone inhibits HAS1 activation by blocking the p38 mitogen-activated protein kinase signalling pathway," Rheumatology (Oxford) 43:164-169 (2004).
Thompson et al., "PEGPH20 reduces tumor interstitial fluid pressure and enhances the antitumor activity of docetaxel in a substrate dependent fashion," manuscript accepted but not published, 31 pages.
Van Roon et al., "Leflunomide in the treatment of rheumatoid arthritis. An analysis of predictors for treatment continuation," Br J Clin Pharmacol. 60(3):319-325 (2005).
Yamada et al., "Investigation of the short-term effect of chemonucleolysis with chondroitinase ABC," J Vet Med Sci 63(5):521-525 (2001).
Yocum et al., "Assessment and implication of the allergic sensitivity to a single dose of recombinant human hyaluronidase injection: A double-blind placebo-controlled clinical trial," J Infus Nursing 30:293-299 (2007).
Zhang et al., "Glucocorticoids induce a near-total suppression of hyaluronan synthase mRNA in dermal fibroblasts and in osteoblasts: a molecular mechanism contributing to organ atrophy," Biochem. J. 349: 91-97 (2000).

(56) References Cited

OTHER PUBLICATIONS

Bee et al., "Recombinant human PH20 is well tolerated at higher intravenous and subcutaneous doses in cynomolgus monkeys," EUFEPS 2008, Munich, Germany, poster, 1 page.

Osgood et al., "Pegylated recombinant human hyaluronidase PH20 (PEGPH20) enhances Nab-Paclitaxel efficacy in BxPC-3 human pancreatic cancer xenografts," AACR Annual Meeting 2012, Abstract #5635, Available on-line Mar. 2012. {Retrieved from the internet Mar. 26, 2012].

Osgood et al., "Pegylated recombinant human hyaluronidase PH20 (PEGPH20) enhances Nab-Paclitaxel efficacy in BxPC-3 human pancreatic cancer xenografts," AACR Annual Meeting 2012. Chicago, IL, Presented Apr. 4, 2012. Poster #5635, 1 page.

Byerley et al., "'Cutting out the bull'. Recombinant human hyaluronidase: Moving to an animal-free system," Association of Clinical Embryologists, 2006, Dublin, Ireland. Abstract published in Human Fertility 9(2):110 (2006).

Dychter et al., "Targeting hyaluronan in tumor stroma. Interim translational and biomarker evaluations of pegylated hyaluronidase (PEGPH20) in animal models and patients with advanced solid tumors," European Organisation for Research and Treatment of Cancer-National Cancer Institute—American Society of Clinical Oncology (EORTC-NCI-ASCO) Annual Meeting on "Molecular Markers in Cancer", Oct. 27-29, 2011, Brussels, Belgium. European Journal oc Cancer 47(Suppl.4): S30-S31, PP60, abstract, 2 pages.

Frost et al., "Punctuated equilibrium: The evolution of recombinant human hyaluronidase," Ophthalmic Anesthesia Society, 2006, Chicago, IL, abstract, 1 page.

Frost et al., "Punctuated equilibrium: The evolution of recombinant human hyaluronidase," Ophthalmic Anesthesia Society, 2006, Chicago, IL, presentation, 35 pages.

Frost, G., "Investor Presentation Jefferies 2011 Global Healthcare Conference," New York, NY Jun. 9, 2011, 22 pages.

Halozyme Therapeutics, J.P. Morgan 29th Annual Healthcare Conference Presentation, Jan. 12, 2011, 35 pages.

Halozyme Therapeutics, "Matrix therapies for life," Presented at Canaccord Cardiovascular, Diabetes & Obesity Conference, Dec. 8, 2010, 38 pages.

Halozyme Therapeutics, Analyst and Investor Meeting presentations "Matrix therapeutics for life," presentations including Lim, J., "Introduction and strategy overview, Roche program update," Gustafson, K., "Strategic deployment of cash," Wasserman, R., "HyQ treatment of primary immunodeficiency patients," Muchmore, D., "Ultrafast insulin-clinical results and ongoing trials," Cefalu, W., "Unmet needs in diabetes management," Little, R., Market overview—ultrafast insulin and SC immunoglobulin and Frost, G., "PEGPH20 and HTI-501 status report," Presented Oct. 14, 2010 in New York, NY., 124 pages.

Halozyme Therapeutics, Jefferies 2010 Global life science conference call, Published on Jun. 8, 2010[online][Retrieved from:<URL:wsw.com/webcast/jeff46/hzym/ [7 pages].

Halozyme Therapeutics, Jefferies Investor Presentation "Matrix therapies for life ," New York, Jun. 17, 2009 [30 pages].

Infante et al., "Targeting hyaluronan (HA) in tumor (T) stroma. Interim safety and translational evaluation of pegylated hyaluronidase (PEGPH20, P) in patients (PTS) with advanced solid tumors—a focus on GI malignancies," 2012 Gastrointestinal Cancers Symposium, Jan. 19-21, 2012, San Francisco, CA. Abstract available Jan. 12, 2012, 3 pages.

Jiang et al "PEGPH20: PEGylated recombinant human hyaluronidase antitumor activity in the 4T1 orthotopic breast carcinoma model," AACR Apr. 9 2009, Abstract, 1 page.

Jiang et al., "Hyaluronan (HA) accumulation in tumors correlates with response to pegylated rHuPH20 hyaluronidase (PEGPH20) in human tumors: a biomarker strategy," American Association for Cancer Research (AACR-EORTC) Annual Meeting, San Francisco, CA. Presented Nov. 14, 2011. Poster board No. B35, 1 page.

Jiang et al., "Hyaluronan (HA) accumulation in tumors correlates with response to pegylated rHuPH20 hyaluronidase (PEGPH20) in human tumors: a biomarker strategy," American Association for Cancer Research (AARC-EORTC) Annual Meeting, San Francisco, CA. Published on-line Nov. 12, 2011. Abstract No. B35, 2 pages.

Kadhim et al., "Antitumor activity of pegylated recombinant human hyaluronidase (PEGPH20) in xenograft and syngeneic Rat MatLyLu prostate carcinoma models," [abstract]. In: Proceedings of the 100$^{th}$ Annual Meeting of the American Association for Cancer Research; Apr. 18-22, 2009; Denver, CO. Philadelphia(PA):AACR; 2009. Abstract No. 260. 1 page.

Kadhim et al., "Antitumor activity of pegylated recombinant human hyaluronidase (PEGPH20) in xenograft and syngeneic Rat MatLyLu prostate carcinoma models," [poster]. In: Proceedings of the 100$^{th}$ Annual Meeting of the American Association for Cancer Research; Apr. 18-22, 2009; Denver, CO. Philadelphia(PA):AACR; 2009. Poster No. 260. 1 page.

Kadhim et al., "PEGPH20: PEGylated human recombinant PH20 hyaluronidase shows significant antitumor activity concomitant with hyaluronan reduction in the PC3 hormone refractory prostate cancer model," [poster]. In: Proceedings of the 100$^{th}$ Annual Meeting of the American Association for Cancer Research; Apr. 18-22, 2009; Denver, CO. Philadelphia(PA):AACR; 2009. Poster No. 8569. 1 page.

Kadhim et al., "Synergistic anti-tumor effects of pegylated recombinant human hyaluronidase (PEGPH20) with Gemcitabine in subcutaneous pancreatic cancer xenograft models," [abstract]. In: Proceedings of the 101$^{st}$ Annual Meeting of the American Association for Cancer Research; Apr. 17-21, 2010; Washington D.C., AACR; 2010. Abstract No. 5392. 2 pages.

Kadhim et al., "Synergistic anti-tumor effects of pegylated recombinant human hyaluronidase (PEGPH20) with cytotoxic agents following intravenous administration in a hormone refractory prostate cancer xenograft model," [abstract]. American Association for Cancer Research (AACR) Translational Cancer Medicine Meeting; Jul. 21, 2008; Monterey, CA, AACR; 2010. Abstract No. A45. 1 page.

Kadhim et al., "Synergistic anti-tumor effects of pegylated recombinant human hyaluronidase (PEGPH20) with cytotoxic agents following intravenous administration in a hormone refractory prostate cancer xenograft model," [poster]. American Association for Cancer Research (AACR) Translational Cancer Medicine Meeting; Jul. 21, 2008; Monterey, CA, AACR; 2010. Poster No. A45. 1 page.

Kang et al., "Chronic treatment with PEGylated human recombinant PH20 hyaluronidase (PEGPH20) reverses diet-induced insulin resistance (IR) in mice," ADA May 2011, Abstract, 1 page.

Kang et al., "Chronic treatment with PEGylated human recombinant PH20 hyaluronidase (PEGPH20) reverses diet-induced insulin resistance (IR) in mice," ADA May 2011, Oral Presentation, 21 pages.

Keller et al., "Pharmacokinetic, pharmacodynamic and toxicologic effects of a recombinant human hyaluronidase (rHuPH20) in rodent and non-human primate models," Hyaluronan (ISHAS) 2007, Charleston, SC, Abstract, 1 page.

Kozak et al., "Recombinant human hyaluronidase facilitates dexamethasone penetration into the posterior ocular segment after sub-Tenon's injection," Association for Research in Vision and Ophthalmology Annual Meeting, May 1-5, 2005, Fort Lauderdale, FL, Abstract, 2 pages.

Li et al, "PEGylated human recombinant hyaluronidase (PEGPH20) removes peritumoral hyaluronan and increases the efficacy of chemotherapy and radiotherapy in an experimental brain metastisis model," AACR Apr. 19, 2009, Abstract #262, 2 pages.

Li et al., "Pegylated human recombinant hyaluronidase PH20 reduces solid tumor hypoxia," [abstract]. American Association for Cancer Research (AACR) Annual Meeting; Mar. 31-Apr. 4, 2012; Chicago, IL, AACR; 2012. Abstract No. 3796. 1 page.

Lim et al., "Matrix therapies for life," 28th Annual JP Morgan Healthcare Conference San Francisco Jan. 13, 2010, 42 pages.

Maneval et al., "Phase 1 pharmacokinetics (PK) & pharmacodynamics (PD) of PEGylated hyaluronidase PH20 (PEGPH20) in patients with solid tumors," [abstract]. American Association for Cancer Research (AACR) Annual Meeting; Mar. 31-Apr. 4, 2012; Chicago, IL, AACR; 2012. Abstract No. 2672. 1 page.

(56) References Cited

OTHER PUBLICATIONS

Pinkstaff et al., "Evaluation of the compatibility and pharmacokinetics of co-formulated biologics with recombinant human hyaluronidase: dose response," American Association of Pharmaceutical Scientists Conference, Nov. 2006, San Antonio, TX, Poster, 1 page.

Pinkstaff et al., "Evaluation of the compatibility and pharmacokinetics of co-formulated biologics with recombinant human hyaluronidase: dose response," American Association of Pharmaceutical Scientists Conference, Nov. 2006, San Antonio, TX, Abstract, 2 pages.

Ramanathan et al., "Targeting hyaluronan in tumor stroma: Interim translational & biomarker evaluations of pegylated hyaluronidase (PEGPH20) in animal models & patients with advanced solid tumors," European Organisation for Research and Treatment of Cancer—National Cancer Institute—American Society of Clinical OFncology (EORTC-NCI-ASCO) Annual Meeting on "Molecular Markers in Cancer", Oct. 27-29, 2011, Brussels, Belgium, Poster, 1 page.

Shepard et al., "Targeting hyaluronan (HA) in the tumor stroma. Translational evaluation of pegylated hyaluronidase (PEGPH20) in animal models and patients with advanced solid tumors," [poster]. EORTC-ASCO-NCI meeting; Oct. 19, 2010; Hollywood, FL, EORTC-ASCO-NCI; 2010. 1 page.

Shepard et al.,"Hyaluronan: The glue that holds a tumor together," [oral presentation]. Biotherapeutic Targets; May 21, 2010; Boston, MA, 26 pages.

Shepard et al.,"PEGPH20—a targeted therapy for cancer treatment," [oral presentation]. Target Discovery World Congress; Aug. 4-5, 2009; South San Francisco, CA, 13 pages.

Singha et al., "Enzymatic depletion of pericellular HA sensitize antibody dependent cell-mediated cytotoxicity," [abstract]. Proceedings of the $102^{nd}$ Annual Meeting of the American Association for Cancer Research; Apr. 2-6, 2011; Orlando, FL:AACR; 2011. Abstract No. 3665. 1 page.

Thompson et al., "Intravenous administration of recombinant human hyaluronidase (rHuPH20) modulates tumor interstitial fluid pressure and pericellular hyaluronan in a human prostate carcinoma xenograft model," American Association for Cancer Research Annual Meeting, 2008, San Diego, CA, Abstract, 1 page.

Thompson et al., "Intravenous administration of recombinant human hyaluronidase (rHuPH20) modulates tumor interstitial fluid pressure and pericellular hyaluronan in a human prostate carcinoma xenograft model," American Association for Cancer Research Annual Meeting, Apr. 12-16, 2008, San Diego, CA, poster, 4 pages.

Whatcott et al., "Hyaluronan deposition correlates with poor survival in pancreatic cancer," American Association of Cancer Research Annual Meeting, Orlando, FL Apr. 5, 2011, abstract, 1 page.

Halozyme Website, "Products & pipeline—PEGPH20," [online][retrieved on Nov. 17, 2011] Retrieved from:<URL:halozyme.com/Products-And-Pipeline/Pipeline/PEGPH20/default.aspx [2 pages].

News release, "Halozyme therapeutics presents positive pre-clinical single agent data for PEGPH20," Jan. 26, 2009, 2 pages.

News Release, Halozyme Therapeutics, Inc., Halozyme therapeutics announces positive findings with pegylated enzyme in prostate cancer models, Published on Jul. 22, 2008[online][retrieved on Nov. 6, 2009] Retrieved from:<URL: drugs.com/clinical_trials/halozyme-therapeutics-announces-positive-findings-pegylated-enzyme-prostate-cancer-models-5142.html [4 pages].

News Release, Halozyme Therapeutics, Inc., "Halozyme therapeutics, inc. begins phase 1 clinical study with PEGPH20 in cancer patients with refractory solid tumors," Published on Mar. 31, 2009[online][retrieved on Apr. 27, 2010] Retrieved from:<URL:in.reuters.com/money/quotes/keyDevelopments?symbol=HALO.O [1 page].

Partial International Search Report, dated Nov. 24, 2011, in connection with International Patent Application No. PCT/US2011/044281, 6 pages.

International Search Report and Written Opinion, dated Jan. 25, 2012, in connection with International Application No. PCT/US2011/044281, 26 pages.

Adams et al., "The c-myc oncogene driven by immunoglobulin enhancers induces lymphoid malignancy in transgenic mice," Nature 318:533-538 (1985).

Alexander et al., "Expression of the c-myc oncogene under control of an immunoglobulin enhancer in E mu-myc transgenic mice," Mol. Cell Biol. 7:1436-1444 (1987).

Altschul, S., "Basic local alignment search tool," J Molec Biol 215(3):403-410 (1990).

Ansel, H., Introduction to Pharmaceutical Dosage Forms, Fourth Edition, Philadelphia: Lea & Febiger, p. 126 (1985).

Arming et al., "In vitro mutagenesis of PH-20 hyaluronidase from human sperm," Eur J Biochem 247(3):810-814 (1997).

Auvinen, P. "Hyaluronan in peritumoral stroma and malignant cells associates with breast cancer spreading and predicts survival," American Journal of Pathology 156(2):529-536 (2000).

Baumgartner et al., "Phase I study in chemoresistant loco-regional malignant disease with hyaluronidase," Reg. Cancer Treat. 1:55-58 (1988).

Benhar et al., "Pseudomonas exotoxin A mutants. Replacement of surface-exposed residues in domain III with cysteine residues that can be modified with polyethylene glycol in a site-specific manner," J. Biol. Chem. 269:13398-14404 (1994).

Benoist, C. and P. Chambon, "In vivo sequence requirements of the SV40 early promotor region," Nature 290:304-310 (1981).

Bertrand et al., "Hyaluronan (hyaluronic acid) and hyaluronectin in the extracellular matrix of human breast carcinomas: comparison between invasive and non-invasive areas," Int. J. Cancer 52:1-6 (1992).

Brumeanu et al., "Derivatization with monomethoxypolyethylene glycol of Igs expressing viral epitopes obviates adjuvant requirements," J Immunol. 154:3088-3095 (1995).

Caliceti, P. and F. Veronese, "Pharmacokinetic and biodistribution properties of poly(ethylene glycol)-protein conjugates," Adv. Drug Deliv. Rev. 55(10):1261-1277 (2003).

Chao, H and A. Spicer, "Natural antisense mRNAs to hyaluronan synthase 2 inhibit hyaluronan biosynthesis and cell proliferation," J. Biol. Chem. 280(30):27513-27522 (2005).

Chapman et al., "Therapeutic antibody fragments with prolonged in vivo half-lives," Nature Biotech. 17:780-783 (1999).

Chenevert et al., "Monitoring early response of experimental brain tumors to therapy using diffusion magnetic resonance imaging," Clin Cancer Res. 3(9):1457-1466 (1997).

Cheng et al., "PEGylated adenoviruses for gene delivery to the intestinal epithelium by the oral route," Pharm. Res. 20(9):1444-1451 (2003).

Danilkovitch-Miagkova, et al., "Hyaluronidase 2 negatively regulates RON receptor tyrosine kinase and mediates transformation of epithelial cells by jaagsiekte sheep retrovirus," Proc Natl Acad Sci US A. 100(8):4580-4585 (2003).

De Maeyer et al., "The growth rate of two transplantable murine tumors, 3LL lung carcinoma and B16F10 melanoma, is influenced by Hyal-1, a locus determining hyaluronidase levels and polymorphism," Int. J. Cancer 51:657-660 (1992).

DeBoer et al., "The tac promoter: a functional hybrid derived from the trp and lac promoters," Proc. Natl. Acad. Sci. USA 80:21-25 (1983).

Delpech et al., "Enzyme-linked hyaluronectin: a unique reagent for hyaluronan assay and tissue location and for hyaluronidase activity detection," Anal. Biochem. 229:35-41 (1995).

Derwent Abstract for WO 1988002261 (Item DI). Inventor: Baumgartne et al., WPI Acc No. 1988-105412/198815, Abstract published 1988, 2 pages.

Devereux et al., "A comprehensive set of sequence analysis programs for the VAX," Nucleic Acids Research 12:387-395 (1984).

Ducale et al., "Regulation of hyaluronan synthase-2 expression in human intestinal mesenchymal cells: mechanisms of interleukin-1beta-mediated induction, " Am J.Physiol Gastrointest Liver Physiol 289(3):G462-G470 (2005).

(56) References Cited

OTHER PUBLICATIONS

Edward et al., "4-Methylumbelliferone inhibits tumour cell growth and the activation of stromal hyaluronan synthesis by melanoma cell-derived factors," Br. J. Dermatol. 162(6):1224-1232 (2010).
Engström-Laurent, A, "Hyaluronan in joint disease," J Intern Med. 242(1):57-60 (1997).
Ernst et al., "Enzymatic degradation of glycosaminoglycans," Critical Reviews in Biochemistry and Molecular Biology 30(5):387-444 (1995).
Fadnes et al., "Interstitial fluid pressure in rats measured with a modified wick technique," Microvasc. Res. 14(1):27-36 (1977).
Felix et al., "Pegylated peptides. IV. Enhanced biological activity of site-directed pegylated GRF analogs," Int. J. Peptide Res. 46:253-264 (1995).
Frost, G. and R. Stern, "A microtiter-based assay for hyaluronidase activity not requiring specialized reagents," Anal. Biochem. 251:263-269 (1997).
Frost, G., "Recombinant human hyaluronidase (rHuPH20): an enabling platform for subcutaneous drug and fluid administration," Expert Opin. Drug. Deliv. 4:427-440 (2007).
Gardner et al., "The complete nucleotide sequence of an infectious clone of cauliflower mosaic virus by M13mp7 shotgun sequencing," Nucleic Acids Res. 9:2871-2888 (1981).
Gilbert, W. and L. Villa-Komaroff, "Useful Proteins from Recombinant Bacteria," Scientific American 242(4):74-94 (1980).
Gribskov et al., "Sigma factors from *E. coli, B. subtilis*, phage SP01, and phage T4 are homologous proteins," Nucl. Acids Res. 14:6745-6763 (1986).
Grosschedl et al., "Introduction of a mu immunoglobulin gene into the mouse germ line: specific expression in lymphoid cells and synthesis of functional antibody," Cell 38:647-658 (1984).
Guiotto et al., "An improved procedure for the synthesis of branched polyethylene glycols (PEGs) with the reporter dipeptide Met-betaAla for protein conjugation," Bioorg. Med. Chem. Lett. 12:177-180 (2002).
Hamai et al., "Two distinct chondroitin sulfate ABC lyases. An endoeliminase yielding tetrasaccharides and an exoeliminase preferentially acting on oligosaccharides," J Biol Chem. 272(14):9123-9130 (1997).
Hammer et al., "Diversity of alpha-fetoprotein gene expression in mice is generated by a combination of separate enhancer elements," Science 235:53-58 (1987).
Hanahan, D., "Heritable formation of pancreatic beta-cell tumours in transgenic mice expressing recombinant insulin/simian virus 40 oncogenes," Nature (3)15:115-122 (1985).
Harris, J., and R. Chess, "Effect of pegylation on pharmaceuticals," Nat Rev Drug Discov 2(3):214-221 (2003).
Heldin et al., "High interstitial fluid pressure—an obstacle in cancer therapy." Nat Rev Cancer, 4 (10):806-813 (2004).
Herrera-Estrella et al., "Expression of chimaeric genes transferred into plant cells using a ti-plasmid-derived vector," Nature 303:209-213 (1984).
Herrera-Estrella et al., "Light-inducible and chloroplast-associated expression of a chimaeric gene introduced into Nicotiana tabacum using a Ti plasmid vector," Nature 310(5973):115-120 (1984).
Hibi et al., "Chondroitinase C activity of *Streptococcus intermedius*," FEMS-Microbiol-Lett. 48(2):121-124 (1989).
Hovingh, P. and A. Linker, "Hyaluronidase activity in leeches (Hirudinea)," Comp Biochem Physiol B Biochem Mol Biol. 124(3):319-326 (1999).
Itano, N. and K. Kimata, "Altered hyaluronan biosynthesis in cancer progression," Seminars in Cancer Biology 18:268-274 (2008).
IUPAC-IUB Commission on Biochemical Nomenclature, "A One-Letter Notation for Amino Acid Sequences: Tentative Rules," J. Biol. Chem. 243:3557-3559 (1968).
IUPAC-IUB, "Abbreviated nomenclature of synthetic poypeptides-polymerized amino acids—revised recommendations," Commission on Biochemical Nomenclature, Biochemistry 11:1726-1731 (1972).
Jay et al., "Construction of a general vector for efficient expression of mammalian proteins in bacteria: use of a synthetic ribosome binding site," Proc. Natl. Acad. Sci. USA 78:5543-5548 (1981).
Jiang et al., "Hyaluronan in tissue injury and repair," Annu Rev Cell Dev Biol. 23:435-461 (2007).
Karvinen et al., "Hyaluronan, CD44 and versican in epidermal keratinocyte tumors," British Journal of Dermatology 148:86-94 (2003).
Kelsey et al., "Species- and tissue-specific expression of human alpha 1—antitrypsin in transgenic mice," Genes and Devel. 1:161-171 (1987).
Kimata et al., "Increased synthesis of hyaluronic acid by mouse mammary carcinoma cell variants with high metastatic potential," Cancer Res. 43: 1347-1354 (1983).
Knudson, C. and W. Knudson, "Hyaluronan-binding proteins in development, tissue homeostasis, and disease," FASEB J. 7:1233-1241 (1993).
Krumlauf et al., "Developmental regulation of alpha-fetoprotein genes in transgenic mice," Mol. Cell. Biol. 5:1639-1648 (1985).
Krupers et al., "Complexation of poly(ethylene oxide) with poly(acrylic acid-co-hydroxyethyl methacrylate)s," Eur. Polym J. 32(6):785-790 (1996).
Lalancette et al, "Characterization of an 80-kilodalton bull sperm protein identified as PH-20," Biol Reprod. 65(2):628-636 (2001).
Laurent, T. and J. Fraser, "Hyaluronan," FASEB J 6:2397-2404 (1992).
Leder et al., "Consequences of widespread deregulation of the c-myc gene in transgenic mice: multiple neoplasms and normal development," Cell 45:485-495 (1986).
Lipponen et al "High stromal hyaluronan level is associated with poor differentiation and metastasis in prostate cancer," European Journal of Cancer 37:849-856 (2001).
Lokeshwar et al., "Antitumor activity of hyaluronic acid synthesis inhibitor 4-methylumbelliferone in prostate cancer cells," Cancer Res 70(7):2613-2623 (2010).
Lokeshwar et al., "Tumor-associated hyaluronic acid: a new sensitive and specific urine marker for bladder cancer," Cancer Res. 57(4):773-777 (1997).
Lokeshwar et al., "Urinary hyaluronic acid and hyaluronidase: markers for bladder cancer detection and evaluation of grade," J. Urol. 163(1):348-356 (2000).
Lu, Y. and A. Felix, "Pegylated peptides I: Solid-phase synthesis of N alpha-pegylated peptides using Fmoc strategy," Peptide Res 6:140-146 (1993).
Lu, Y. and A. Felix, "Pegylated peptides. II. Solid-phase synthesis of amino-, carboxy- and side-chain pegylated peptides," Int. J. Peptide Protein Res. 43:127-138 (1994).
Magram et al., "Developmental regulation of a cloned adult beta-globin gene in transgenic mice," Nature 315:338-340 (1985).
Mason et al., "The hypogonadal mouse: reproductive functions restored by gene therapy," Science 234:1372-1378 (1986).
Mehvar, R., "Modulation of the pharmacokinetics and pharmacodynamics of proteins by polyethylene glycol conjugation," J. Pharm. Pharmaceut. Sci. 3(1):125-136 (2000).
Michelacci, Y. and C. Dietrich, "Chondroitinase C from Flavobacterium heparinum," J. Biol. Chem. 251:1154-1158 (1976).
Mire-Sluis et al., "Recommendations for the design and optimization of immunoassays used in the detection of host antibodies against biotechnology products," Journal of Immunological Methods 289(1-2):1-16 (2004).
Molineux, G., "Pegylation: engineering improved biopharmaceuticals for oncology," Pharmacotherapy 23 (8 Pt 2):3S-8S (2003).
Monfardini et al, "A branched monomethoxypoly(ethylene glycol) for protein modification," Bioconjugate Chem. 6: 62-69 (1995).
Morohashi et al., "Study of hyaluronan synthase inhibitor, 4-methylumbelliferone derivatives on human pancreatic cancer cell (KP1-NL)," Biochem Biophys Res Commun. 345(4):1454-1459 (2006).
Nakazawa et al., "4-methylumbelliferone, a hyaluronan synthase suppressor, enhances the anticancer activity of gemcitabine in human pancreatic cancer cells," Cancer Chemother Pharmacol 57(2):165-70 (2006).

(56) References Cited

OTHER PUBLICATIONS

Needleman, S. and C. Wunsch "A general method applicable to the search for similarities in the amino acid sequence of two proteins," J Mol Biol. 48:443-453 (1970).
Nishida et al., "Antisense inhibition of hyaluronan synthase-2 in human articular chondrocytes inhibits proteoglycan retention and matrix assembly," J. Biol. Chem. 274(31):21893-1899 (1999).
Ohya, T., and Y. Kaneko, "Novel hyaluronidase from streptomyces," Biochim. Biophys. Acta 198:607-609 (1970).
Ornitz et al., "Elastase I promoter directs expression of human growth hormone and SV40 T antigen genes to pancreatic acinar cells in transgenic mice," Cold Spring Harbor Symp. Quant. Biol. 50:399-409 (1986).
Ozzello et al., "Growth-promoting activity of acid mucopolysaccharides on a strain of human mammary carcinoma cells," Cancer Res. 20:600-604 (1960).
Pawlowski et al., "The effects of hyalurodinase upon tumor formation in BALB/c mice painted with 7,12-dimethylbenz-(a)anthracene," Int. J. Cancer 23:105-109 (1979).
Pearson, W. and D. Lipman, "Improved tools for biological sequence comparison," Proc. Natl. Acad. Sci. USA 851:2444-2448 (1988).
Pham et al., "Large-scale transient transfection of serum-free suspension-growing HEK293 EBNA1 cells: peptone additives improve cell growth and transfection efficiency," Biotechnology and Bioengineering 84:332-342 (2003).
Pinkert et al., "An albumin enhancer located 10 kb upstream functions along with its promoter to direct efficient, liver-specific expression in transgenic mice," Genes and Devel. 1:268-276 (1987).
Pirinen et al "Prognostic value of hyaluronan expression in non-small cell lung cancer: Increased stromal expression indicated unfavorable outcome in patients with adenocarcinoma" Int. J. Cancer 95:12-17 (2001).
Readhead et al., "Expression of a myelin basic protein gene in transgenic shiverer mice: correction of the dysmyelinating phenotype," Cell 48:703-712 (1987).
Roberts et al., "Chemistry for peptide and protein PEGylation," Advanced Drug Delivery Review 54:459-476 (2002).
Ropponen et al., "Tumor Cell-associated Hyaluronan as an Unfavorable Prognostic Factor in Colorectal Cancer," Cancer Research 58:342-347 (1998).
Sato et al., "Cloning and expression in *Escherichia coli* of the gene encoding the Proteus vulgaris chondroitin ABC lyase," Appl. Microbiol. Biotechnol. 41(1):39-46 (1994).
Sato, H., "Enzymatic procedure for site-specific pegylation of proteins," Adv. Drug Deliv. Rev. 54:487-504 (2002).
Sawhney et al., "Bioerodible hydrogels based on photopolymerized poly(ethylene glycol)-co poly(hydroxyl acid) Diacrylate Macromers," Macromolecules 26:581-587 (1993).
Shani, M., "Tissue-specific expression of rat myosin light-chain," Nature 314:283-286 (1985).
Simpson et al., "Manipulation of hyaluronan synthase expression in prostate adenocarcinoma cells alters pericellular matrix retention and adhesion to bone marrow endothelial cells," J. Biol. Chem. 277(12):10050-10057 (2002).
Smith, T. and M. Waterman, "Comparison of biosequences," Advances in Applied Mathematics 2:482-489 (1981).
St Croix et al., "Reversal of intrinsic and acquired forms of drug resistance by hyaluronidase treatment of solid tumors," Cancer Lett 131(1):35-44 (1998).
Stuhlmeier, K., "Effects of leflunomide on hyaluronan synthases (HAS): NF-kappa B-independent suppression of IL-1-induced HAS1 transcription by leflunomide," J Immunol 174(11):7376-7382 (2005).
Swift et al., "Tissue-specific expression of the rat pancreatic elastase I gene in transgenic mice," Cell 38:639-646 (1984).
Takahashi et al., "A fluorimetric Morgan-Elson assay method for hyaluronidase activity," Anal. Biochem. 322:257-263 (2003).

Takeuchi et al., "Variation in glycosaminoglycan components of breast tumors," Cancer Res. 36:2133-2139 (1976).
Tammi et al., "Hyaluronan in human tumors: pathobiological and prognostic messages from cell-associated and stromal hyaluronan," Seminar in Cancer Biology 18:288-395 (2008).
Thompson et al., "Enzymatic Depletion of Tumor Hyaluronan Induces Antitumor Responses in Preclinical Animal Models" Molecular Cancer Therapeutics 9(11):3052-3064 (2010).
Tkalec et al., "Isolation and expression in *Escherichia coli* of cs1A and cs1B, genes coding for the chondroitin sulfate-degrading enzymes chondroitinase AC and chondroitinase B, respectively, from Flavobacterium heparinum," Applied and Environmental Microbiology 66(1):29-35 (2000).
Tsubery et al., "Prolonging the action of protein and peptide drugs by a novel approach of reversible polyethylene glycol modification," J Biol. Chem 279(37):38118-38124 (2004).
Tsuda et al., "Substrate specificity studies of flavobacterium chondroitinase C and heparitinases towards the glycosaminoglycan—protein linkage region. Use of a sensitive analytical method developed by chromophore-labeling of linkage glycoserines using dimethylaminoazobenzenesulfonyl chloride," Eur. J. Biochem. 262:127-133 (1999).
Udabage L., "Antisense-mediated suppression of hyaluronan synthase 2 inhibits the tumorigenesis and progression of breast cancer" Cancer Res. 65(14):6139-6150 (2005).
Veronese et al., "Branched and Linear Poly(Ethylene Glycol): Influence of the Polymer Structure on Enzymological, Pharmacokinetic, and Immunological Properties of Protein Conjugates," J. Bioactive Compatible Polymers 12:197-207 (1997).
Wagner et al., "Nucleotide sequence of the thymidine kinase gene of herpes simplex virus type 1," Proc. Natl. Acad. Sci. USA 78:1441-1445 (1981).
Yamagata, et al., "Purification and properties of bacterial chondroitinases and chondrosulfatases," J. Biol. Chem. 243(7):1523-1535 (1968).
Yamamoto et al., "Identification of a functional promoter in the long terminal repeat of Rous sarcoma virus," Cell 22:787-797 (1980).
Yang et al., "Purification and characterization of heparinase from Flavobacterium heparinum," J. Biol. Chem. 160(30):1849-1857 (1985).
Yoshihara et al., "A hyaluronan synthase suppressor, 4-methyltunbelliferone, inhibits liver metastasis of melanoma cells," FEBS Lett 579(12):2722-2726 (2005).
Zalipsky, S., "Chemistry of polyethylene glycol conjugates with biologically active molecules," Adv. Drug Del. Rev. 16:157-182 (1995).
Zanker et al., "Induction of response in previous chemotherapy resistant patients by hyaluronidase," Proc. Amer. Assoc. Cancer Res. 27:390 Abstract 1550 (1986).
Zhao, X. and J. Harris, in "Poly(ethylene glycol), Chemistry and Biological Applications" ACS Symposium Series 680, Hams, J. and S. Zalipsky (eds), 458-472 (1997).
Frost, G., "Halozyme Therapeutics, Inc. Thinking outside the cell," Oct. 2013. Presentation, 46 pages.
Torley, H., "Halozyme Therapeutics, Inc. The next chapter begins: creating value through growth," Presented at the 32nd Annual J.P. Morgan Healthcare Conference Jan. 2014, 26 pages.
News release, Halozyme Therapeutics, Inc., "Halozyme announces temporary halt of phase 2 trial enrollment and dosing for PEGPH20," published Apr. 4, 2014 [retrieved Apr. 14, 2014] Retrieved from: <URL:halozyme.com/Investors/News-Releases/News-Release-Details/2014/Halozyme-Announces-Temporary-Halt-Of-Phase-2-Trial-Enrollment-And-Dosing-For-PEGPH20/default.aspx, 2 pages.
News release, Halozyme Therapeutics, Inc., "Halozyme announces clinical hold of PEGPH20 pancreatic cancer trial following voluntary halt of trial by Halozyme," published Apr. 9, 2014 [retrieved Apr. 14, 2014] Retrieved from: <URL:halozyme.com/Investors/News-Releases/News-Release-Details/2014/Halozyme-Announces-Clinical-Hold-of-PEGPH20-Pancreatic-Cancer-Trial-Following-Voluntary-Halt-of-Trial-by-Halozyme/default.aspx, 2 pages.

(56) References Cited

OTHER PUBLICATIONS

News Release, Halozyme Therapeutics, Inc., "Halozyme announces preclinical data presentations at the Association of Cancer Research Annual Meeting," Published Apr. 8, 2014 [Retrieved Apr. 14, 2014] Retrieved from: <URL:halozyme.com/Investors/News-Releases/News-Release-Details/2014/Halozyme-Announces-Preclinical-Data-Presentations-At-The-Association-Of-Cancer-Research-Annual-Meeting/default.aspx, 3 pages.

Letter/Written Disclosure of the Supplemental Information Disclosure Statement for the above-referenced application, dated Mar. 19, 2014, 2 pages.

Ochi et al., "Leflunomide-induced polymyositis in a patient with rheumatoid arthritis," 19(4):443-446 (2009).

Bee et al., "Recombinant human PH20 is well tolerated at higher intravenous and subcutaneous doses in cynomolgus monkeys," EUFEPS 2008, Munich, Germany. Poster and individual panels, 9 pages.

Hingorani et al., "A phase 1b study of gemcitabine plus PEGPH20 (pegylated recombinant human hyaluronidase) in patients with stage IV previously untreated pancreatic cancer," 2013 European Cancer Congress (ECC) Annual Meeting, Amsterdam, Netherlands—Sep. 27-Oct. 10, 2013, Abstract #2598, 2 pages.

Hingorani et al., "A phase 1b multicenter international study of gemcitabine combined with PEGPH20 (PEGylated recombinant human hyaluronidase) in patients with stage IV previously untreated pancreatic cancer," 2013 European Cancer Congress (ECC) Annual Meeting, Amsterdam, Netherlands—Sep. 27-Oct. 1, 2013, Poster #2598 and individual panels, 5 pages.

Jiang et al "PEGPH20: PEGylated recombinant human hyaluronidase antitumor activity in the 4T1 orthotopic breast carcinoma model" 2009 AACR Apr. 9, 2009. Poster #267 and individual panels, 8 pages.

Keller et al., "Pharmacokinetic, Pharmacodynamic and Toxicologic Effects of a Recombinant Human Hyaluronidase (rHuPH20) in Rodent and Non-Human Primate models," Presented at International Society for Hyaluronan Sciences (ISHAS) Annual Meeting 2007, Charleston, SC. Poster and individual panels, 14 pages.

Kozak et al., "Recombinant human hyaluronidase facilitates dexamethasone penetration into the posterior ocular segment after sub-Tenon's injection," Association for Research in Vision and Ophthalmology Annual Meeting, May 1-5, 2005, Fort Lauderdale, FL. Poster #478 and individual panels, 5 pages.

Kultti et al., "Extracellular hyaluronan accumulation by hyaluronan synthase 3 promotes pancreatic cancer growth and modulates tumor microenvironment via epithelial-mesenchymal transition," AACR Annual Meeting 2014. San Diego, CA Abstract #4844, Available on-line Mar. 2014 [Retrieved form the internet Mar. 18, 2014], 1 page.

Li et al, "PEGylated human recombinant hyaluronidase (PEGPH20) removes peritumoral hyaluronan and increases the efficacy of chemotherapy and radiotherapy in an experimental brain metastasis model" 2009 American Association for Cancer Research (AACR) Annual Meeting, Apr. 19, 2009. Abstract #262, 2 pages.

Li et al, "PEGylated human recombinant hyaluronidase (PEGPH20) removes peritumoral hyaluronan and increases the efficacy of chemotherapy and radiotherapy in an experimental brain metastasis model" Poster #262 2009 American Association for Cancer Research (AACR) Annual Meeting., Apr. 19, 2009. Poster #262 and individual panels, 5 pages.

Osgood et al., "Pegylated recombinant human hyaluronidase PH20 (PEGPH20) enhances cetuximab efficacy in BxPC-3/HAS3 human pancreatic cancer xenografts," AACR Annual Meeting 2014. San Diego, CA Abstract #3646, Available on-line Mar. 2014 [Retrieved form the internet Mar. 18, 2014], 1 page.

Singha et al., "PEGPH20 depletion of pericellular hyaluronan sensitizes high hyaluronan-producing tumor cells in antibody-dependent cell-mediated cytotoxicity" [abstract]. In: Proceedings of the AACR Special Conference on Molecularly Targeted Therapies: Mechanisms of Resistance; May 9-12, 2012; San Diego, CA. Philadelphia (PA): AACR; Clin Cancer Res 2012;18(10 Suppl):Abstract nr B6, 2 pages.

Wei et al., "Functions of N-linked glycans on human hyaluronidase PH20," presented at San Diego Glycobiology Symposium 2009. Poster 83 and individual panels, 5 pages.

Wei et al., "Structure function analysis of the human hyaluronidase enzymes," Matrix Biology 27 (Supplement 1):541, Dec. 2008, American Society for Matrix Biology (ASMB) Biennial Meeting, San Diego, CA, (available on-line Nov. 17, 2008), Abstract 132 (corresponding to poster B4), 2 pages.

Wei et al., "Structure function analysis of the human hyaluronidase enzymes," Presented at American Society for Matrix Biology (ASMB) Biennial Meeting, San Diego, CA, Dec. 9, 2008. Poster B4 and individual panels, 5 pages.

Halozyme Therapeutics, "United States Securities and Exchange Commission, form 10-K, Part I" for fiscal year ending Dec. 31, 2013, filed Feb. 28, 2014, 32 pages.

Halozyme Therapeutics, "United States Securities and Exchange Commission, form 10-K, Part I," for fiscal year ending Dec. 31, 2012, filed Mar. 1, 2013, 30 pages.

Halozyme Therapeutics, "United States Securities and Exchange Commission Form 10Q" for quarterly period ending Mar. 31, 2013, filed May 8, 2013, 50 pages.

Halozyme Therapeutics, "United States Securities and Exchange Commission Form 10Q," for quarterly period ending Jun. 30, 2013, filed Aug. 7, 2013, 54 pages.

Halozyme Therapeutics, "United States Securities and Exchange Commission Form 10Q," for quarterly period ending Sep. 30, 2013, filed Nov. 8, 2013, 56 pages.

News release, "Halozyme studies target hyaluronan surrounding solid tumors, May offer new approach to cancer treatment," Published on Apr. 20, 2009 [online][retrieved on Feb. 17, 2014], Retrieved from:<URL:halozyme.com/Investors/News-Releases/News-Release-Details/2009/Halozyme-Studies-Target-Hyaluronan-Surrounding-Solid-Tumors-May-Offer-New-Approach-to-Cancer-Treatment/default.aspx, 3 pages.

Letter/Written Disclosure of the Supplemental Information Disclusure Statement for the above-referenced application, filed Sep. 3, 2014, 2 pages.

Office Action, dated Aug. 5, 2014, in connection with Japanese Patent Application No. 2013-520768 [English translation and original document in Japanese], 8 pages.

Fattal-German et al., "Expression and modulation of ICAM-1, TNF-alpha and RANTES in human alveolar macrophages from lung-transplant recipients in vitro," Transpl Immunol. 6(3):183-192 (1998).

Hew et al., "Relative corticosteroid insensitivity of peripheral blood mononuclear cells in severe asthma," Am J Respir Crit Care Med. 174(2):134-141 (2006).

Palmer et al., "Induction of nitric oxide synthase in human chondrocytes," Biochem Biophys Res Commun. 193(1):398-405 (1993).

Letter/Written Disclosure of the Supplemental Information Disclusure Statement for the above-referenced application, filed herewith May 11, 2015, 2 pages.

News Release, Halozyme Therapeutics, Inc., "Halozyme Therapeutics Provides an Update on Anticipated Milestones for 2015 at the 33rd Annual J. P. Morgan Healthcare Conference," Published Jan. 12, 2015, Retrieved from: <URL: halozyme.com/Investors/News-Releases/News-Release-Details/2015/Halozyme-Therapeutics-Provides-An-Update-On-Anticipated-Milestones-For-2015-At-The-33rd-Annual-J-P-Morgan-Healthcare-Conference/default.aspx [retrieved on Jan. 14, 2015], 3 pages.

News Release, Halozyme Therapeutics, Inc., "Halozyme Announces Preclinical Study Results of PEGPH20 Published in Molecular Cancer Therapeutics," Published Feb. 17, 2015, Retrieved from: <URL: halozyme.com/Investors/News-Releases/News-Release-Details/2015/Halozyme-Announces-Preclinical-Study-Results-Of-PEGPH20-Published-In-Molecular-Cancer-Therapeutics/default.aspx [retrieved on Feb. 20, 2015], 3 pages.

(56) References Cited

OTHER PUBLICATIONS

Office Action, dated Jan. 28, 2015, in connection with Korean Patent Application No. 10-2013-7004292 [English translation and original document in Korean], 21 pages.
Letter, dated Apr. 29, 2015, providing translation of Office Action dated Mar. 31, 2015, in connection with Mexican Patent Application No. MX/a/2013/000728 [letter and original Office Action in Spanish], 8 pages.
Letter/Written Disclosure of the Supplemental Information Disclusure Statement for the above-referenced application, filed herewith Jul. 13, 2015, 3 pages.
Examination Report, dated May 27, 2015 and received Jun. 15, 2015, 2015, in connection with Canadian Patent Application No. 2,806,058, 6 pages.
Letter/Written Disclosure of the Supplemental Information Disclusure Statement for the above-referenced application, filed herewith Feb. 13, 2015, 2 pages.
Huang et al., "Characterization of hyaluronan, hyaluronidase PH20, and HA synthase HAS2 in inflammation and cancer," Inflammation & Cell Signaling, 1:e306 (2014).
Kang et al., "Hyaluronan accumulates with high fat feeding and contributes to insulin resistance," Diabetes. 62(6):1888-1896 (2013) [Epub Jan. 24, 2013].
Singha et al., "Tumor-associated Hyaluronan Limits Efficacy of Monoclonal Antibody Therapy," Mol Cancer Ther. Dec. 15, 2014. pii: molcanther.0580.2014. [Epub ahead of print].
Halozyme Therapeutics, "United States Securities and Exchange Commission Form 10Q, Part I," for quarterly period ending Mar. 31, 2014, filed May 12, 2014, 55 pages.
News release, Halozyme Therapeutics, Inc., "Halozyme Announces Podium Presentation on PEGPH20 at the New York Academy of Sciences," Published Oct. 9, 2014 [online], Retrieved from:<URL:halozyme.com/Investors/News-ReleasestNews-Release-Details/2014/Halozyme-Announces-Podium-Presentation-On-PEGPH20-At-The-New-York-Academy-Of-Sciences/default.aspx [retrieved on Oct. 10, 2014], 3 pages.
News Release, Halozyme Therapeutics, Inc., "Halozyme Receives Orphan Drug Designation for PEGylated Recombinant Human Hyaluronidase PH20 for Pancreatic Cancer," Published Oct. 3, 2014 [online], Retrieved from:<URL: http://www.halozyme.com/Investors/News-Releases/News-Release-Details/2014/Halozyine-Receives-Orphan-Drug-Designation-For-PEGylated-Recombinant-Human-Hyaluronidase-PH20-For-Pancreatic-Cancer/default.aspx [retrieved on Oct. 7, 2014], 2 pages.
News Release, Halozyme Therapeutics Inc., "Halozyme Reports Third Quarter 2014 Financial Results," Published Nov. 10, 2014 [online], Retrieved from:<URL:halozyme.com/Investors/News-Releases/News-Release-Details/2014/Halozyme-Reports-Third-Quarter-2014-Financial-Results/default.aspx [retrieved on Nov. 11, 2014], 7 pages.
News Release, Halozyme Therapeutics, Inc., "Halozyme's PEGPH20 Program in Metastatic Pancreatic Cancer Receives Fast Track Designation," Published on Sep. 3, 2014 [online], Retrieved from:<URL:halozyme.com/Investors/News-Releases/News-Release-Details/2014/Halozymes-PEGPH20-Program-In-Metastatic-Pancreatic-Cancer-Receives-Fast-Track-Designation/default.aspx [retrieved on Sep. 15, 2014], 2 pages.
News Release, "Halozyme to Resume PEGPH20 Clinical Program in Pancreatic Cancer," Published Jun. 4, 2014 [online], Retrieved from the internet: <URL: halozyme.com/Investors/News-Releases/News-Release-Details/2014/Halozyme-To-Resume-PEGPH20-Clinical-Program-In-Pancreatic-Cancer/default.aspx [retrieved on Jun. 6, 2014], 2 pages.
News Release, "Halozyme Resumes Patient Enrollment and Dosing in PEGPH20 Clinical Program in Pancreatic Cancer," Published Jul. 22, 2014 [online], Retrieved from the internet: <URL:halozyme.com/Investors/News-Releases/News-Release-Details/2014/Halozyme-Resumes-Patient-Enrollment-And-Dosing-In-PEGPH20-Ciinical-Program-In-Pancreatic-Cancer/default [retrieved on Aug. 18, 2014], 3 pages.

News Release, "SWOG to Resume Clinical Trial of Halozyme's PEGPH20 in Combination With Modified FOLFIRINOX for Advanced Pancreatic Cancer," Published Sep. 18, 2014 [online], Retrieved from the internet: <URL:halozyme.com/Investors/News-Releases/News-Release-Details/2014/SWOG-To- Resume-Clinical-Trial-Of-Halozymes-PEGPH20-In-Combination-With-Modified-FOLFIRINOX-For-Advanced-Pancreatic-Cancer/default.aspx [retrieved on Sep. 24, 2014], 3 pages.
News Release, "Halozyme Receives European Orphan Drug Designation for PEGylated Recombinant Human Hyaluronidase PH20 for Pancreatic Cancer," Published Dec. 19, 2014 [online], Retrieved from the internet: <URL:halozyme.com/Investors/News-Releases/News-Release-Details/2014/Halozyme-Receives-European-Orphan-Drug-Designation-For-PEGylated-Recombinant-Human-Hyaluronidase-PH20-For-Pancreatic-Cancer/default.aspx [retrieved on Dec. 29, 2014], 3 pages.
"PEGPH20: The Science & The Strategy," presented at J. P. Morgan Healthcare Conference on Jan. 7, 2015. Presentation. 81 pages.
Singha et al., "Hyaluronan (HA) depletion sensitizes HA(high) tumors to antibody-dependent cell-mediated cytotoxicity," presented at San Antonio Breast Cancer Symposium (SABCS), Dec. 9-13, 2014. San Antonio, TX. Abstract P5-04-02, 1 page.
Singha et al., "Hyaluronan (HA) depletion sensitizes HA(high) tumors to antibody-dependent cell-mediated cytotoxicity," presented at San Antonio Breast Cancer Symposium (SABCS), Dec. 9-13, 2014. San Antonio, TX. Poster P5-04-02, 6 pages.
Zhao et al, "Naked mole rat HAS2 and hyaluronan are not tumor suppressive in human tumor xenografts," presented at San Antonio Breast Cancer Symposium (SABCS), Dec. 9-13, 2014. San Antonio, TX. Abstract P4-04-25, 1 page.
Letter, dated Feb. 3, 2015, providing instructions for Response, field Feb. 5, 2015, to Office Action, dated Aug. 5, 2014, in connection with Japanese Patent Application No. 2013-520768, 20 pages.
Letter/Written Disclosure of the Supplemental Information Disclusure Statement for the above-referenced application, filed herewith Mar. 24, 2016, 2 pages.
Hayashida et al., "Oral administration of Lactoferrin inhibits inflammation and nociception in rat adjuvant-induced arthritis," J Vet Med Sci 66(2): 149-154 (2004).
Lyle et al., "Low molecular weight hyaluronic acid effects on murine macrophage nitric oxide production," J Biomed Mater Research A 94(3):893-904 (2010).
Takagishi et al., "Evaluation of intra-articular injection in patients with so-called Gojukata: comparison hyaluronate and steroid," Jpn J Med Pharm Sci. 35:377-381 (1996). [in Japanese].
Takagishi et al., "Evaluation of intra-articular injection in patients with so-called Gojukata: comparison hyaluronate and steroid," Jpn J Med Pharm Sci. 35:377-381 (1996). [English translation].
Response, filed Sep. 15, 2015, to Examiner's Report, dated May 27, 2015, in connection with Canadian Patent Application No. 2,806,058, 38 pages.
Letter, dated Jan. 13, 2016, reporting Notice of Allowance, dated Dec. 4, 2015, in connection with Canadian Patent Application No. 2,806,058, 2 pages.
Office Action, dated Sep. 1, 2015, in connection with Japanese Patent Application No. 2013-520768 [English translation and original document in Japanese], 5 pages.
Response, filed Jul. 24, 2015, to Office Action, dated Jan. 28, 2015 in connection with Korean Patent Application No. 10-2013-7004292 [English instructions and document as filed in Korean], 103 pages.
Office Action, dated Nov. 26, 2015, in connection with Korean Patent Application No. 10-2013-7004292 [English translation and original document in Korean], 7 pages.
Response, filed Jul. 24, 2015, to Office Action dated Mar. 31, 2015, in connection with Mexican Patent Application No. MX/a/2013/000728 [English instructions and Response as filed in Spanish], 39 pages.
Letter, dated Dec. 15, 2015, providing translation of Office Action that dated Nov. 23, 2015, in connection with Mexican Patent Application No. MX/a/2013/000728 [letter and original Office Action in Spanish], 9 pages.

(56) References Cited

OTHER PUBLICATIONS

Letter/Written Disclosure of the Supplemental Information Disclusure Statement for the above-referenced application, filed herewith Mar. 2, 2017, 3 pages.
Decision to Grant, issued Jan. 31, 2017, in connection with Japanese Patent Application No. 2015-254453 [English reporting letter and original document in Japanese], 4 pages.
Notice of Rejection of Amendment and Notice of Final Rejection, each dated Feb. 1, 2017, in connection with Korean Patent Application No. 10-2013-7004292 [English translations, original documents in Korean and referenced document (Notice of Preliminary Rejection dated Nov. 26, 2015)], 15 pages.
Letter/Written Disclosure of the Supplemental Information Disclusure Statement for the above-referenced application, filed herewith Jun. 15, 2016, 3 pages.
Office Action, dated May 10, 2016, in connection with Japanese Patent Application No. 2015-254453 [English Translation and original document in Japanese], 5 pages.
Letter/Written Disclosure of the Supplemental Information Disclusure Statement for the above-referenced application, filed herewith Dec. 1, 2016, 2 pages.
Melamed et al., "Recombinant Human Hyaluronidase Facilitates Dispersion of Subcutaneously Administered Gammagard Liquid and Enables Administration of a Full Monthly Dose in a Single Site to Patients with Immunodeficiency Diseases," J Allergy Clin Immunol, vol. 121 No. 2, Suppl.1, Feb. 2008 (Feb. 2008), p. S83 [1 page].
Letter, dated Sep. 21, 2016, reporting Official Action, dated Sep. 20, 2016, issued in connection with Israeli Patent Application No. 223889 [English translation and cited reference XP002663399=Ochi et al. (2009)], 6 pages.
Response, filed Oct. 7, 2016, to Official Action, dated May 10, 2016, in connection with Japanese Patent Application No. 2015-254453 [English Instructions, document as filed in Japanese and English translation of claims as-filed], 90 pages.
Response, filed May 26, 2016, to Office Action, dated Nov. 26, 2015, in connection with Korean Patent Application No. 10-2013-7004292 [English instructions and document as filed in Korean], 67 pages.
Notice of Final Rejection, dated Sep. 30, 2016, issued in connection with Korean Patent Application No. 10-2013-7004292 [English translation and original document in Korean. D1=WO 2009/128917 and D2=US 2003/0190360], 8 pages.
Response, filed Mar. 28, 2016, to Office Action, dated Nov. 17, 2015, in connection with Mexican Patent Application No. MX/a/2013/000728 [English instructions and Response as filed in Spanish], 48 pages.
Letter, dated Aug. 12, 2016, providing translation of Office Action that dated Jul. 27, 2016, in connection with Mexican Patent Application No. MX/a/2013/000728 [English letter and original Office Action in Spanish], 12 pages.
Letter/Written Disclosure of the Supplemental Information Disclusure Statement for the above-referenced application, filed herewith Jun. 14, 2017, 2 pages.
Bower et al., "*Necator americanus*: the Na-ASP-2 protein secreted by the infective larvae induces neutrophil recruitment in vivo and in vitro," Exp Parasitol 118(4):569-575 (2008).
Declaration by Narine Lalayeva, dated Nov. 18, 2016, 5 pages.
Franchi et al., "Cell model of inflammation," Biosci Rep 28:23-32 (2008).
Vartanian et al., "Injected hyaluronidase reduces restylane-mediated cutaneous augmentation," Arch Facial Plast Surg 7: 231-237 (2005).
Zimmet, S. E., "Hyaluronidase in the prevention of sclerotherapy-induced extravasation necrosis (a dose-response study)," Dermatol Surg 22:73-76 (1996).
Ma et al., "Evaluating clinically relevant pharmacological agents in a rat ambulation model to ameliorate PEGylated recombinant hyaluronidase PH20 (PEGPH20)-mediated musculoskeletal adverse events," presented at AACR Annual Meeting, Apr. 2, 2017. Washington D.C. Abstract #1240/25 [retrieved Mar. 17, 2017; available online Mar. 1, 2017], 2 pages.
Response, filed Jan. 18, 2017, to Official Action, dated Sep. 21, 2016, in connection with Israeli Patent Application No. 223889 [English language translation], 26 pages.
Official Action, dated Dec. 13, 2016, in connection with Japanese Patent Application No. 2015-254453 [English Translation and original document in Japanese], 5 pages.
Response, filed Jan. 17, 2017, to Official Action, dated Dec. 13, 2016, in connection with Japanese Patent Application No. 2015-254453 [English Instructions and document as filed in Japanese], 25 pages.
Response, filed Jan. 2, 2017, to Notice of Final Rejection, dated Sep. 30, 2016, in connection with Korean Patent Application No. 10-2013-7004292 [English instructions and document as filed in Korean], 57 pages.
Office Action, issued Mar. 3, 2017, in connection with Korean Patent Application No. 10-2017-7000101 [English translation and original document in Korean], 9 pages.
Response, filed May 4, 2017, to Office Action, dated Mar. 3, 2017, in connection with Korean Patent Application No. 10-2017-7000101 [English instructions; documents cited in response; and document as filed in Korean], 129 pages.
Response, dated Dec. 5, 2016, to Office Action, dated Jul. 27, 2016, in connection with Mexican Patent Application No. MX/a/2013/000728 [English instructions and Response as filed in Spanish], 51 pages.
Letter, dated Apr. 25, 2017, providing translation of Notice of Allowance dated Apr. 3, 2017, in connection with Mexican Patent Application No. MX/a/2013/000728 [letter and original Notice of Allowance in Spanish], 3 pages.
U.S. Appl. No. 15/591,011, filed May 9, 2017.
U.S. Appl. No. 14/936,290, filed Nov. 9, 2015, 2016-005164, Feb. 25, 2016.
U.S. Appl. No. 14/628,120, filed Feb. 20, 2015, 2015-0165059, Jun. 18, 2015.
U.S. Appl. No. 13/507,263, filed Jun. 15, 2012, 2013-0011378, Jan. 10, 2013.
U.S. Appl. No. 13/507,262, filed Jun. 15, 2012, 2013-0022588, Jan. 24, 2013.
U.S. Appl. No. 15/226,489, filed Aug. 2, 2016, 2016-0362670, Dec. 15, 2016.
U.S. Appl. No. 13/507,261, filed Jun. 15, 2012, 2013/0022592, Jan. 24, 2013.
Letter/Written Disclosure of the Supplemental Information Disclusure Statement for the above-referenced application, filed herewith Aug. 16, 2017, 3 pages.
Notification Prior to Acceptance, issued Jun. 12, 2017, in connection with Israeli Patent Application No. 223889 [English language translation], 2 pages.
Office Action, dated Jul. 4, 2017, in connection with Mexican Patent Application No. MX/a/2014/001305 [English translation and original document in Spanish], 7 pages.
Letter/Written Disclosure of the Supplemental Information Disclosure Statement for the above-referenced application, filed herewith on Oct. 12, 2017, 4 pages.
Communication under Rule 71(3) EPC (Intention to Grant), dated Aug. 11, 2017 and received Sep. 15, 2017, in connection with corresponding European Patent Application No. 11735755.8, 7 pages.
Decision to Grant, dated Sep. 20, 2017 and received Sep. 28, 2017, in connection with corresponding Korean Patent Application No. 10-2017-7000101 [English translation and original document in Korean], 3 pages.
Official Action, dated Oct. 3, 2017, in connection with Japanese Patent Application No. 20170 48448 [English Translation and original document in Japanese], 8 pages.

* cited by examiner

ADVERSE SIDE-EFFECTS ASSOCIATED WITH ADMINISTRATION OF AN ANTI-HYALURONAN AGENT AND METHODS FOR AMELIORATING OR PREVENTING THE SIDE-EFFECTS

RELATED APPLICATIONS

Benefit of priority is claimed to U.S. Provisional Application Ser. No. 61/399,993, entitled "ADVERSE SIDE-EFFECT ASSOCIATED WITH ADMINISTRATION OF PEGYLATED HYALURONIDASE AND METHODS FOR AMELIORATING OR PREVENTING THE SIDE-EFFECTS," filed on Jul. 20, 2010 to Harold Michael Shepard, Curtis Thompson, Ziaoming Li and Gregory I. Frost, and to U.S. Provisional Application Ser. No. 61/455,260, entitled "ADVERSE SIDE-EFFECTS ASSOCIATED WITH ADMINISTRATION OF ANTI-HYALURONAN AGENTS AND METHODS FOR AMELIORATING OR PREVENTING THE SIDE-EFFECTS," filed on Oct. 14, 2010, to Harold Michael Shepard, Curtis Thompson, Ziaoming Li and Gregory I. Frost.

This application is related to International Application No. PCT/US2011/044281, filed the same day herewith, entitled "ADVERSE SIDE-EFFECTS ASSOCIATED WITH ADMINISTRATION OF ANTI-HYALURONAN AGENTS AND METHODS FOR AMELIORATING OR PREVENTING THE SIDE-EFFECTS," which claims priority to U.S. Provisional Application Ser. Nos. 61/399,993 and 61/455,260. The subject matter of the above-noted related application is incorporated by reference in its entirety.

This application is related to U.S. application Ser. No. 12/386,222, filed Apr. 14, 2009, which is published as US2010003238, which claims priority to U.S. Provisional Appl. Nos. 61/124,278, 61/130,357 and 61/195,624. This application also is related to International PCT Application No. PCT/US2009/002352, filed Apr. 14, 2009, which is published as WO2009128917, and which also claims priority to U.S. Provisional Appl. Nos. 61/124,278, 61/130,357 and 61/195,624.

The subject matter of each of the above-referenced applications is incorporated by reference in its entirety.

INCORPORATION BY REFERENCE OF SEQUENCE LISTING PROVIDED ON COMPACT DISCS

An electronic version on compact disc (CD-R) of the Sequence Listing is filed herewith in duplicate (labeled Copy #1 and Copy #2), the contents of which are incorporated by reference in their entirety. The computer-readable file on each of the aforementioned compact discs, created on Jul. 15, 2011, is identical, 824 kilobytes in size, and titled P3084seq.001.txt.

FIELD OF THE INVENTION

Provided are methods associated with the use of anti-hyaluronan agents, such as hyaluronan degrading enzymes, for single-agent therapy or combination therapy.

BACKGROUND

Hyaluronan (hyaluronic acid; HA) is a polysaccharide that is found in the extracellular matrix of many tissues, especially in soft connective tissues. HA also is found predominantly in skin, cartilage, and in synovial fluid in mammals. Hyaluronan also is the main constituent of the vitreous of the eye. HA has a role in various physiological processes, such as in water and plasma protein homeostasis (Laurent T C et al. (1992) *FASEB J* 6: 2397-2404). Certain diseases and disorders are associated with expression and/or production of hyaluronan. Hyaluronidases are enzymes that degrade hyaluronan. By catalyzing the breakdown of HA, hyaluronidases can be used alone or in combination with other therapeutic agents to treat diseases or disorders associated with accumulation of HA or other glycosaminoglycans.

SUMMARY

Provided herein are methods for ameliorating or preventing an adverse effect in a subject from an administered anti-hyaluronan agent by administering an amount of a corticosteroid to the subject sufficient to ameliorate the adverse effect. The corticosteroid can be a glucocorticoid. For example, the glucocorticoid can be a cortisone, dexamethasone, hydrocortisone, methylprednisolone, prednisolone or prednisone, and in particular is a dexamethasone. In one example, the corticosteroid is administered orally.

In some examples of the methods provided herein, the adverse effect is a musculoskeletal side effect. For example, the adverse effect is muscle and joint pain, stiffness of upper extremities, stiffness of lower extremities, cramping, myositis, muscle soreness and tenderness over the entire body, weakness, fatigue and a decrease in range of motion at knee or elbow joints. Typically, the adverse effect is one that results in a dose-limiting toxicity (DLT) of the anti-hyaluronan agent. In the methods, the corticosteroid is administered in an amount to eliminate or increase dose that results in the DLT of the anti-hyaluronan agent. In another example, the adverse effect is a Grade 3 on a toxicity scale and the corticosteroid is administered in an amount to reduce the Grade to Grade 1 or Grade 2 or to Grade 3 that resolves within hours of administration of the corticosteroid.

In the methods, the anti-hyaluronan agent that is administered is administered orally, intravenously (IV), subcutaneously, intramuscularly, intra-tumorally, intradermally, topically, transdermally, rectally or sub-epidermally. Generally, the anti-hyaluronan agent is a hyaluronan degrading enzyme or is an agent that inhibits hyaluronan synthesis. For example, the anti-hyaluronan agent is an agent that inhibits hyaluronan synthesis such as a sense or antisense nucleic acid molecule against an HA synthase or is a small molecule drug. For example, an anti-hyaluronan agent is 4-methylumbelliferone (MU) or a derivative thereof, or leflunomide or a derivative thereof. Such derivatives include, for example, a derivative of 4-methylumbelliferone (MU) that is 6,7-dihydroxy-4-methyl coumarin or 5,7-dihydroxy-4-methyl coumarin. In other examples, the anti-hyaluronan agent is a hyaluronan degrading enzyme that is modified by conjugation to a polymer. The polymer can be a PEG and the anti-hyaluronan agent a PEGylated hyaluronan degrading enzyme.

Provided herein are methods for ameliorating an adverse effect of systemic administration of a PEG hyaluronan degrading enzyme to a subject. The methods involve systemically administering a PEGylated hyaluronan degrading enzyme, particularly a PEGylated hyaluronidase, such as any of the animal or bacterial hyaluronidases, to the subject and administering an amount of a corticosteroid sufficient to ameliorate the adverse effect. In one example of the provided methods, the corticosteroid is administered orally. In another example, PEGylated hyaluronan degrading enzyme is administered intravenously. Administration of the corticosteroid and/or the PEGylated hyaluronan degrading enzyme can be effected systemically by any suitable route, such as, for example, intravenously, orally or intramuscularly.

In the provided methods, the adverse effects associated with administration of a PEGylated hyaluronan degrading enzyme are musculoskeletal side effects. Musculoskeletal side effects include, for example, muscle and joint pain, stiffness of upper and lower extremities, cramping, myositis, muscle soreness and tenderness over the entire body, weakness, fatigue and/or a decrease in range of motion at knee and elbow joints.

In some examples, the corticosteroid is a glucocorticoid. For example, the corticosteroid is a glucocorticoid selected from among cortisones, dexamethasones, hydrocortisones, methylprednisolones, prednisolones and prednisones. In a particular example, the glucocorticoid is a dexamethasone.

In the provided methods, the corticosteroid is administered prior to, concurrent with, intermittently with or subsequent to administration of the PEGylated hyaluronan degrading enzyme. In one embodiment of the methods, the corticosteroid is co-administered with the PEGylated hyaluronan degrading enzyme. For example, the corticosteroid is administered prior to administration of the PEGylated hyaluronan degrading enzyme. In this example, the corticosteroid is administered at or about 0.5 minutes, 1 minute, 2 minutes, 3 minutes, 4 minutes, 5 minutes, 6 minutes, 7 minutes, 8 minutes, 9 minutes, 10 minutes, 15 minutes, 20 minutes, 25 minutes, 30 minutes, 45 minutes, 1 hour, 2 hours, 3 hours, 4 hours, 5 hours, 6 hours, 7 hours, 8 hours, 9 hours, 10 hours, 11 hours, 12 hours, 18 hours, 24 hours, 36 hours or more prior to the administration of the PEGylated hyaluronan degrading enzyme. In a particular example, administration of the corticosteroid is at least at or about 1 or more hours prior to administration of the PEGylated hyaluronan degrading enzyme.

In another embodiment of the methods, the corticosteroid is administered subsequent to administration of the PEGylated hyaluronan degrading enzyme. For example, the corticosteroid is administered at or about 0.5 minutes, 1 minute, 2 minutes, 3 minutes, 4 minutes, 5 minutes, 6 minutes, 7 minutes, 8 minutes, 9 minutes, 10 minutes, 15 minutes, 20 minutes, 25 minutes, 30 minutes, 45 minutes, 1 hour, 2 hours, 3 hours, 4 hours, 5 hours, 6 hours, 7 hours, 8 hours, 9 hours, 10 hours, 11 hours, 12 hours, 18 hours, 24 hours or more after the administration of the PEGylated hyaluronan degrading enzyme. In another example, administration of the corticosteroid is at least 8 hours to 12 hours after administration of the PEGylated hyaluronan degrading enzyme.

In yet another embodiment of the methods, the corticosteroid is administered prior to and after administration of the PEGylated hyaluronan degrading enzyme. For example, the corticosteroid is administered one to five minutes immediately before administration of the PEGylated hyaluronan degrading enzyme and eight hours after administration of the PEGylated hyaluronan degrading enzyme. In another example, the corticosteroid is administered one hour before administration of the PEGylated hyaluronan degrading enzyme and eight to twelve hours after administration of the PEGylated hyaluronan degrading enzyme. In the methods provided herein, any dosing regime is contemplated as long as the time of dosing of the corticosteroid ameliorates the one or more side effects associated with administration of the PEGylated hyaluronan degrading enzyme.

In some embodiments of the methods, the corticosteroid is administered in an amount between at or about 0.1 to 20 mgs, 0.1 to 15 mgs, 0.1 to 10 mgs, 0.1 to 5 mgs, 0.2 to 20 mgs, 0.2 to 15 mgs, 0.2 to 10 mgs, 0.2 to 5 mgs, 0.4 to 20 mgs, 0.4 to 15 mgs, 0.4 to 10 mgs, 0.4 to 5 mgs, 0.4 to 4 mgs, 1 to 20 mgs, 1 to 15 mgs or 1 to 10 mgs. In a particular embodiment, the corticosteroid is administered in an amount between at or about 0.4 to 20 mgs. Exemplary doses of corticosteroid are any dose that ameliorates the one or more side effects associated with administration of the PEGylated hyaluronan degrading enzyme.

In one embodiment of the methods, the PEGylated hyaluronan degrading enzyme is administered in an amount of at or about 0.0005 mg/kg, 0.0006 mg/kg, 0.0007 mg/kg, 0.0008 mg/kg, 0.0009 mg/kg, 0.001 mg/kg, 0.0016 mg/kg, 0.002 mg/kg, 0.003 mg/kg, 0.004 mg/kg, 0.005 mg/kg, 0.006 mg/kg, 0.007 mg/kg, 0.008 mg/kg, 0.009 mg/kg, 0.01 mg/kg, 0.016 mg/kg, 0.02 mg/kg, 0.03 mg/kg, 0.04 mg/kg, 0.05 mg/kg, 0.06 mg/kg, 0.07 mg/kg, 0.08 mg/kg, 0.09 mg/kg, 0.1 mg/kg, 0.15 mg/kg, 0.2 mg/kg, 0.25 mg/kg, 0.30 mg/kg, 0.35 mg/kg, 0.40 mg/kg, 0.45 mg/kg, 0.5 mg/kg, 0.55 mg/kg, 0.6 mg/kg, 0.7 mg/kg, 0.8 mg/kg, 0.9 mg/kg, 1.0 mg/kg, 1.1 mg/kg, 1.2 mg/kg, 1.3 mg/kg, 1.4 mg/kg, 1.5 mg/kg, 1.6 mg/kg, 1.7 mg/kg, 1.8 mg/kg, 1.9 mg/kg, 2 mg/kg, 2.5 mg/kg, 3 mg/kg, 3.5 mg/kg, 4 mg/kg, 4.5 mg/kg, 5 mg/kg, 5.5 mg/kg, 6 mg/kg, 6.5 mg/kg, 7 mg/kg, 7.5 mg/kg, 8 mg/kg, 8.5 mg/kg, 9 mg/kg, 9.5 mg/kg or 10 mg/kg of the mass of the subject to whom it is administered.

In another embodiment of the methods, the PEGylated hyaluronan degrading enzyme is administered in an amount of at or about 10 Units/kg (U/kg), 16 U/kg, 32 U/kg, 64 U/kg, 100 U/kg, 200 U/kg, 300 U/kg, 400 U/kg, 500 U/kg, 600 U/kg, 700 U/kg, 800 U/kg, 900 U/kg, 1,000 U/kg, 2,000 U/kg, 3,000 U/kg, 4,000 U/kg, 5,000 U/kg, 6,000 U/kg, 7,000 U/kg, 8,000 U/kg, 9,000 U/kg, 10,000 U/kg, 12,800 U/kg, 20,000 U/kg, 32,000 U/kg, 40,000 U/kg, 50,000 U/kg, 60,000 U/kg, 70,000 U/kg, 80,000 U/kg, 90,000 U/kg, 100,000 U/kg, 120,000 U/kg, 140,000 U/kg, 160,000 U/kg, 180,000 U/kg, 200,000 U/kg, 220,000 U/kg, 240,000 U/kg, 260,000 U/kg, 280,000 U/kg, 300,000 U/kg, 320,000 U/kg, 350,000 U/kg, 400,000 U/kg, 450,000 U/kg, 500,000 U/kg, 550,000 U/kg, 600,000 U/kg, 650,000 U/kg, 700,000 U/kg, 750,000 U/kg, 800,000 U/kg of the mass of the subject to whom it is administered.

In a particular embodiment of the method, the PEGylated hyaluronan degrading enzyme is administered in an amount between at or about 10 and 320,000 Units/kg of the mass of the subject and the corticosteroid is administered in an amount between at or about 0.4 to 20 mgs.

In some embodiments of the method, the PEGylated hyaluronan degrading enzyme used in the methods is a hyaluronidase, for example, any animal or bacterial hyaluronidase. In some examples, the hyaluronidase is a soluble hyaluronidase. For example, the hyaluronidase is soluble PH20 hyaluronidase that is selected from among a human, monkey, bovine, ovine, rat, mouse or guinea pig PH20. In a particular example, the hyaluronidase is human PH20. In other examples, the hyaluronidase is an animal-derived hyaluronidase. For example, hyaluronidase is an animal-derived hyaluronidase selected from among a purified bovine testicular hyaluronidase or a purified ovine testicular hyaluronidase. In a particular aspect of the method, the PEGylated hyaluronan degrading enzyme is PEGylated PH20 (PEGPH20) and the corticosteroid is dexamethasone.

In one embodiment, the hyaluronidase used in the methods provided herein is neutral active and N-glycosylated. In some aspects, the neutral active and N-glycosylated hyaluronidase polypeptide is a full-length PH20 or is a C-terminal truncated form of the PH20, wherein the full-length PH20 has the sequence of amino acids set forth in SEQ ID NO: 1. In other aspects, the neutral active and N-glycosylated hyaluronidase polypeptide has a sequence of amino acids having at least 85%, 86%, 87%, 88%, 89%, 90%, 91%, 92%, 93%, 94%, 95%, 96%, 97%, 98%, 99% or more sequence identity with the polypeptide or truncated form of sequence of amino acids set forth in SEQ ID NO: 1. In yet another aspect, the neutral active and N-glycosylated hyaluronidase polypeptide is a full-length PH20 or is a C-terminal truncated form of the PH20, that has amino acid substitutions, whereby the hyaluronidase polypeptide has a sequence of amino acids having at least 85%, 86%, 87%, 88%, 89%, 90%, 91%, 92%, 93%, 94%, 95%, 96%, 97%, 98%, 99% or more sequence identity with the polypeptide SEQ ID NO: 1 or the with the corresponding truncated forms thereof. In some aspects, the hyaluronidase polypeptide used in the methods provided herein is encoded by a nucleic acid molecule that has a sequence of nucleotides set forth in SEQ ID NO:49. In some aspects, the hyaluronidase polypeptide used in the methods provided herein is secreted in CHO cells. In a particular example, the PH20 is designated rHuPH20.

In one embodiment of the methods, the hyaluronidase is a neutral active soluble hyaluronidase polypeptide containing at least one N-linked sugar moiety. In a particular aspect, the N-linked sugar moiety is covalently attached to an asparagine residue of the polypeptide. In another aspect, the hyaluronidase is glycosylated at least two sites.

In some aspects, the hyaluronidase used in the methods provided herein, the soluble hyaluronidase has a sequence of amino acids included in SEQ ID NO:1 or a sequence that has at least about 91% amino acid sequence identity with a sequence of amino acids included in SEQ ID NO:1, whereby the hyaluronidase is soluble and truncated at the C-terminus at an amino acid residue that is between amino acid residues 467 to 483, inclusive, of SEQ ID NO:1 or corresponding residues in a polypeptide that has about 91% sequence identity therewith. In a particular example, the hyaluronidase is encoded by a nucleic acid molecule that encodes amino acids 1-482 of SEQ ID NO:1 or amino acids 36-482 of SEQ ID NO:1. In other examples, the soluble hyaluronidase includes at least amino acid residues 36-464 of SEQ ID NO: 1. In other examples, the hyaluronidase includes a sequence of amino acids set forth in SEQ ID NO:1 that is truncated at an amino acid residue that is or is between amino acid residues 467 to 483. For example, the hyaluronidase can include a sequence of amino acids set forth in SEQ ID NO:1 that is truncated at an amino acid residue selected from among amino acid residues 467, 477, 478, 479, 480, 481, 482 and 483. In other examples, the hyaluronidase includes a sequence of amino acids set forth in SEQ ID NO:1 that is truncated at a residue selected from among amino acid residues 467, 468, 469, 470, 471, 472, 473, 474, 475, 476, 477, 478, 479, 480, 490, 491, 492, 493, 494, 495, 496, 497, 498, 499 and 500. In some aspects, the hyaluronidase polypeptide used in the methods provided herein is a C-terminal truncated form produced and secreted in mammalian cells. In a particular example, the mammalian cells are CHO cells.

In the methods provided herein, the hyaluronan degrading enzyme is PEGylated. In a particular example, the PEG moieties are branched. In some examples, the PEG moieties are selected from among mPEG-SBA (5 kDa), mPEG-SBA (20 kDa), mPEG-SBA (30 kDa), mPEG-SMB (20 kDa), mPEG-SMB (30 kDa), mPEG-butyraldehyde (30 kDa), mPEG-SPA (20 kDa), mPEG-SPA (30 kDa), mPEG2-NHS (10 kDa branched), mPEG2-NHS (20 kDa branched), mPEG-NHS (40 kDa branched), mPEG2-NHS (60 kDa branched), PEG-NHS-biotin (5 kDa biotinylated), PEG-p-nitrophenyl-carbonate (30 kDa) and PEG-propionaldehyde (30 kDa).

In the methods herein, the adverse effects can be a result of treatment by the anti-hyaluronan agent of a hyaluronan associated disease or condition. In one example, the hyaluronan associated disease or condition is one that is associated with high interstitial fluid pressure, a cancer, edema, disc pressure and an inflammatory disease. For example, a disease or condition that is edema can be caused by organ transplant, stroke or brain trauma. In another example, an inflammatory disease or condition includes Rheumatoid arthritis, scleroderma, periodontitis, psoriasis, atherosclerosis, chronic wounds, Crohn's disease, ulcerative colitis and inflammatory bowel disease.

In a further example, the adverse effect is a result of treatment by the anti-hyaluronan agent of a cancer that is a tumor, for example a solid tumor. The tumor can be one that has increased cellular and/or stromal expression of a hyaluronan, compared to a non-cancerous tissue of the same tissue type or compared to a non-metastatic tumor of the same tumor-type. In one example, the cancer is a late-stage cancer, a metastatic cancer and an undifferentiated cancer. In another example, the cancer is ovarian cancer, in situ carcinoma (ISC), squamous cell carcinoma (SCC), prostate cancer, pancreatic cancer, non-small cell lung cancer, breast cancer, brain cancer or colon cancer.

Also provided herein are uses and compositions containing a corticosteroid for ameliorating adverse effects associated with treatment with an anti-hyaluronan agent.

Also provided herein are methods of treatment and uses of a polymer-conjugated hyaluronan-degrading enzyme (i.e. a hyaluronan-degrading enzyme modified by conjugation to a polymer) for use in treating a hyaluronan-associated disease or condition. In such methods or uses, the hyaluronan-degrading enzyme is administered in a dosage range or amount of between or about between 0.01 µg/kg (of the subject) to 15 µg/kg. For example, in the methods provided herein, a hyaluronan-degrading enzyme is administered in a dosage range or amount of between or about between 0.05 µg/kg to 10 µg/kg, 0.75 µg/kg to 7.5 µg/kg or 1.0 µg/kg to 3.0 µg/kg. The frequency of administration is twice weekly, once weekly, once every 14 days, once every 21 days or once every month. In particular examples, the hyaluronan-degrading enzyme is administered in a dosage regime where the cycle of administration is one week, two weeks, three weeks or four weeks. The cycle of administration can be repeated a plurality of times. Also, in some examples, after a cycle of administration, administration is discontinued for a predetermined period of time and then resumed in a subsequent cycle of administration. In some examples, the frequency of administration in the first cycle of administration is the same of different than the frequency of administration in subsequent cycles of administration. In a particular example, the hyaluronan-degrading enzyme is administered twice weekly in the first cycle of administration and once weekly for subsequent cycles of administration. In such examples, the cycle of administration is 4 weeks.

For example, the hyaluronan-degrading enzyme is used or formulated for single dosage administration of an amount in a range between or about between 0.5 µg to 1450 µg or 150 Units (U) to 45,000 Units for treating a hyaluronan-associated disease or condition. In such methods and uses the hyaluronan-degrading enzyme can be administered as a unit dosage of 0.5 µg to 1450 µg or 150 Units (U) to 45,000 Units at a frequency of at least once a week for a cycle of at least 4 weeks. In particular examples, single dosage administration or unit dose is of an amount in a range between or about between 0.75 µg to 1125 µg; 3.75 mg to 750 µg; 56 µg to 565 µg; or 75 µg to 225 µg. In other examples, the single dosage administration or unit dose is in a range between or about between 24 Units (U) to 36,000 U; 120 U to 24,000 U; 1500 U to 18,000 U; or 2400 U to 7200 U.

In any of the methods or uses herein, in particular for treating a hyaluronan-associated disease or condition, hyaluronan expression in a sample from the subject is measured prior to treatment. The hyaluronan associated disease or condition is associated with high interstitial fluid pressure, a cancer, edema, disc pressure or an inflammatory disease. For example, the disease or condition can be an edema caused by organ transplant, stroke or brain trauma. In other examples, the disease or condition is an inflammatory disease that is Rheumatoid arthritis, scleroderma, periodontitis, psoriasis, atherosclerosis, chronic wounds, Crohn's disease, ulcerative colitis or inflammatory bowel disease. In particular examples, the disease or condition is cancer and the cancer is a tumor. For example, the disease or condition is a solid tumor. The tumor can be one that has increased cellular and/or stromal expression of a hyaluronan, compared to a non-cancerous tissue of the same tissue type or compared to a non-metastatic tumor of the same tumor-type. Where the disease or condition is a cancer, the cancer is a late-stage cancer, a metastatic cancer or an undifferentiated cancer. For example, the cancer is ovarian cancer, in situ carcinoma (ISC), squamous cell carcinoma (SCC), prostate cancer, pancreatic cancer, non-small cell lung cancer, breast cancer, brain cancer or colon cancer.

In some examples, a corticosteroid can further be administered. For example, a corticosteroid is a glucocorticoid. For example, the corticosteroid is a glucocorticoid that is a cortisone, dexamethasone, hydrocortisone, methylprednisolone, prednisolone or prednisone. In a particular example, the glucocorticoid is a dexamethasone.

In some embodiments of the methods provided herein, the methods further involve a step of administering a second agent or treatment. In some aspects, the second agent or treatment is a cancer treatment, such as, for example, surgery, radiation, a chemotherapeutic agent, a biological agent, a polypeptide, an antibody, a peptide, a small molecule, a gene therapy vector, a virus or DNA. In particular examples, the second agent is a cancer treatment selected from among Acivicins; Aclarubicins; Acodazoles; Acronines; Adozelesins; Aldesleukins; Alemtuzumabs; Alitretinoins (9-Cis-Retinoic Acids); Allopurinols; Altretamines; Alvocidibs; Ambazones; Ambomycins; Ametantrones; Amifostines; Aminoglutethimides; Amsacrines; Anastrozoles; Anaxirones; Ancitabines; Anthramycins; Apaziquones; Argimesnas; Arsenic Trioxides; Asparaginases; Asperlins; Atrimustines; Azacitidines; Azetepas; Azotomycins; Banoxantrones; Batabulins; Batimastats; BCG Live; Benaxibines; Bendamustines; Benzodepas; Bexarotenes; Bevacizumab; Bicalutamides; Bietaserpines; Biricodars; Bisantrenes; Bisantrenes; Bisnafide Dimesylates; Bizelesins; Bleomycins; Bortezomibs; Brequinars; Bropirimines; Budotitanes; Busulfans; Cactinomycins; Calusterones; Canertinibs; Capecitabines; Caracemides; Carbetimers; Carboplatins; Carboquones; Carmofurs; Carmustines with Polifeprosans; Carmustines; Carubicins; Carzelesins; Cedefingols; Celecoxibs; Cemadotins; Chlorambucils; Cioteronels; Cirolemycins; Cisplatins; Cladribines; Clanfenurs; Clofarabines; Crisnatols; Cyclophosphamides; Cytarabine liposomals; Cytarabines; Dacarbazines; Dactinomycins; Darbepoetin Alfas; Daunorubicin liposomals; Daunorubicins/Daunomycins; Daunorubicins; Decitabines; Denileukin Diftitoxes; Dexniguldipines; Dexonnaplatins; Dexrazoxanes; Dezaguanines; Diaziquones; Dibrospidiums; Dienogests; Dinalins; Disermolides; Docetaxels; Dofequidars; Doxifluridines; Doxorubicin liposomals; Doxorubicin HCL; Doxorubicin HCL liposome injection; Doxorubicins; Droloxifenes; Dromostanolone Propionates; Duazomycins; Ecomustines; Edatrexates; Edotecarins; Eflomithines; Elacridars; Elinafides; Elliott's B Solutions; Elsamitrucins; Emitefurs; Enloplatins; Enpromates; Enzastaurins; Epipropidines; Epirubicins; Epoetin alfas; Eptaloprosts; Erbulozoles; Esorubicins; Estramustines; Etanidazoles; Etoglucids; Etoposide phosphates; Etoposide VP-16s; Etoposides; Etoprines; Exemestanes; Exisulinds; Fadrozoles; Fazarabines; Fenretinides; Filgrastims; Floxuridines; Fludarabines; Fluorouracils; 5-fluorouracils; Fluoxymesterones; Fluorocitabines; Fosquidones; Fostriecins; Fostriecins; Fotretamines; Fulvestrants; Galarubicins; Galocitabines; Gemcitabines; Gemtuzumabs/Ozogamicins; Geroquinols; Gimatecans; Gimeracils; Gloxazones; Glufosfamides; Goserelin acetates; Hydroxyureas; Ibritumomabs/Tiuxetans; Idarubicins; Ifosfamides; Ilmofosines; Ilomastats; Imatinib mesylates; Imexons; Improsulfans; Indisulams; Inproquones; Interferon alfa-2 as; Interferon alfa-2bs; Interferon Alfas; Interferon Betas; Interferon Gammas; Interferons; Interleukin-2s and other Interleukins (including recombinant Interleukins); Intoplicines; Iobenguanes [131-I]; Iproplatins; Irinotecans; Irsogladines; Ixabepilones; Ketotrexates; L-Alanosines; Lanreotides; Lapatinibs; Ledoxantrones; Letrozoles; Leucovorins; Leuprolides; Leuprorelins (Leuprorelides); Levamisoles; Lexacalcitols; Liarozoles; Lobaplatins; Lometrexols; Lomustines/CCNUs; Lomustines; Lonafarnibs; Losoxantrones; Lurtotecans; Mafosfamides; Mannosulfans; Marimastats; Masoprocols; Maytansines; Mechlorethamines; Mechlorethamines/Nitrogen mustards; Megestrol acetates; Megestrols; Melengestrols; Melphalans; MelphalansIL-PAMs; Menogarils; Mepitiostanes; Mercaptopurines; 6-Mercaptopurine; Mesnas; Metesinds; Methotrexates; Methoxsalens; Metomidates; Metoprines; Meturedepas; Miboplatins; Miproxifenes; Misonidazoles; Mitindomides; Mitocarcins; Mitocromins; Mitoflaxones; Mitogillins; Mitoguazones; Mitomalcins; Mitomycin Cs; Mitomycins; Mitonafides; Mitoquidones; Mitospers; Mitotanes; Mitoxantrones; Mitozolomides; Mivobulins; Mizoribines; Mofarotenes; Mopidamols; Mubritinibs; Mycophenolic Acids; Nandrolone Phenpropionates; Nedaplatins; Nelzarabines; Nemorubicins; Nitracrines; Nocodazoles; Nofetumomabs; Nogalamycins; Nolatrexeds; Nortopixantrones; Octreotides; Oprelvekins; Ormaplatins; Ortataxels; Oteracils; Oxaliplatins; Oxisurans; Oxophenarsines; Paclitaxels; Pamidronates; Patubilones; Pegademases; Pegaspargases; Pegfilgrastims; Peldesines; Peliomycins; Pelitrexols; Pemetrexeds; Pentamustines; Pentostatins; Peplomycins; Perfosfamides; Perifosines; Picoplatins; Pinafides; Pipobromans; Piposulfans; Pirfenidones; Piroxantrones; Pixantrones; Plevitrexeds; Plicamycid Mithramycins; Plicamycins; Plomestanes; Plomestanes; Porfimer sodiums; Porfimers; Porfiromycins; Prednimustines; Procarbazines; Propamidines; Prospidiums; Pumitepas; Puromycins; Pyrazofurins; Quinacrines; Ranimustines; Rasburicases; Riboprines; Ritrosulfans; Rituximabs; Rogletimides; Roquinimexs; Rufocromomycins; Sabarubicins; Safingols; Sargramostims; Satraplatins; Sebriplatins; Semustines; Simtrazenes; Sizofurans; Sobuzoxanes; Sorafenibs; Sparfosates;

Sparfosic Acids; Sparsomycins; Spirogermaniums; Spiromustines; Spiroplatins; Spiroplatins; Squalamines; Streptonigrins; Streptovarycins; Streptozocins; Sufosfamides; Sulofenurs; Sunitinib Malate; 6-thioguanine (6-TG); Tacedinalines; Talcs; Talisomycins; Tallimustines; Tamoxifens; Tariquidars; Tauromustines; Tecogalans; Tegafurs; Teloxantrones; Temoporfins; Temozolomides; Teniposides/VM-26s; Teniposides; Teroxirones; Testolactones; Thiamiprines; Thioguanines; Thiotepas; Tiamiprines; Tiazofurins; Tilomisoles; Tilorones; Timcodars; Timonacics; Tirapazamines; Topixantrones; Topotecans; Toremifenes; Tositumomabs; Trabectedins (Ecteinascidin 743); Trastuzumabs; Trestolones; Tretinoins/ATRA; Triciribines; Trilostanes; Trimetrexates; Triplatin Tetranitrates; Triptorelins; Trofosfamides; Tubulozoles; Ubenimexs; Uracil Mustards; Uredepas; Valrubicins; Valspodars; Vapreotides; Verteporfins; Vinblastines; Vincristines; Vindesines; Vinepidines; Vinflunines; Vinformides; Vinglycinates; Vinleucinols; Vinleurosines; Vinorelbines; Vinrosidines; Vintriptols; Vinzolidines; Vorozoles; Xanthomycin As (Guamecyclines); Zeniplatins; Zilascorbs [2-H]; Zinostatins; Zoledronate; Zorubicins; and Zosuquidars.

In the methods provided herein, the subject administered the PEGylated hyaluronan degrading enzyme is a human subject. In a particular aspect of the methods, the subject has cancer and treatment comprises systemically administering a PEGylated hyaluronan degrading enzyme.

In any of the methods or uses provided herein using a hyaluronan-degrading enzyme conjugated to a polymer, the specific activity can be at least or about 20,000 U/mg, 25,000 U/mg, 30,000 U/mg, 31,000 U/mg, 32,000 U/mg, 33,000 U/mg, 34,000 U/mg, 35,000 U/mg, 36,000 U/mg, 37,000 U/mg, 38,000 U/mg, 39,000 U/mg, 40,000 U/mg, 45,000 U/mg, 50,000 U/mg, 55,000 U/mg, 60,000 U/mg or more.

Further provided herein is a combination containing a first composition containing a hyaluronan degrading enzyme formulated for intravenous administration and a second composition comprising a corticosteroid. In particular, in the combinations provided herein the hyaluronan degrading enzyme is a PEGylated hyaluronan degrading enzyme, such as a PEGylated PH20 (e.g. PEGPH20). In other examples of the combinations provided herein, the corticosteroid is a glucocorticoid such as dexamethasone.

Also provided herein is a device containing a composition containing a hyaluronan-degrading enzyme formulated in an amount for direct administration in a range between or about between 0.5 µg to 1450 µg or 150 Units (U) to 45,000 Units per dose. The hyaluronan-degrading enzyme contained in the device is modified by conjugation to a polymer, and the device is for dispensing the composition and is visibly or detectably marked to indicate a single dosage amount for administration. In some examples, the device is for dispensing a plurality of single doses, and each mark indicates a single dosage. The device can be a syringe or a tube or vial. In some examples, the device is a packaged as a kit or combination and contains a composition also contains a corticosteroid formulated for single dosage administration.

Any of the hyaluronan-degrading enzymes described herein or known in the art can be used in the methods or uses for ameliorating a side effect, the methods or uses for treating a hyaluronan-associated disease or condition or in the combinations or contained in the devices herein. Exemplary hyaluronan degrading enzymes provided herein, including soluble hyaluronidases and preparations thereof are described, for example, in U.S. Publication Nos. US20040268425, US20050260186, US20060104968, US20090123367, US20090181013, US20090181032, US20090214505, US20090253175 and US20100143457 and U.S. Pat. No. 7,767,429.

DETAILED DESCRIPTION

Outline

A. DEFINITIONS
B. OVERVIEW
   1. Anti-Hyaluronan Agents and Hyaluronan-associated diseases, conditions and/or disorders
   2. Adverse effects associated with treatment with anti-hyaluronan agents
   3. Use of corticosteroids to ameliorate the adverse effects of anti-Hyaluronan Agents
C. ANTI-HYALURONAN AGENTS
   1. Agents that Inhibit Hyaluronan Synthesis
   2. Hyaluronan Degrading Enzymes
      a. Hyaluronidases
         i. Mammalian-type hyaluronidases PH20
         ii. Bacterial hyaluronidases
         iii. Hyaluronidases from leeches, other parasites and crustaceans
      b. Other hyaluronan degrading enzymes
      c. Soluble hyaluronan degrading enzymes
         i. Soluble Human PH20
         ii. rHuPH20
      d. Glycosylation of hyaluronan degrading enzymes
      e. Modified (Polymer-Conjugated) hyaluronan degrading enzymes
         PEGylated Soluble hyaluronan degrading enzymes
D. METHODS OF PRODUCING NUCLEIC ACIDS AND ENCODED POLYPEPTIDES OF HYALURONAN DEGRADING ENZYMES
   1. Vectors and Cells
   2. Expression
      a. Prokaryotic Cells
      b. Yeast Cells
      c. Insect Cells
      d. Mammalian Cells
      e. Plants
   3. Purification Techniques
   4. PEGylation of Hyaluronan degrading enzymes polypeptides
E. CORTICOSTEROIDS
F. USE OF CORTICOSTEROIDS TO AMELIORATE THE ADVERSE EFFECTS OF AN ANTI-HYALURONAN AGENT
   1. Pharmaceutical Compositions and Formulations
   2. Dosages and Administration
      a. Corticosteroid
      b. Anti-Hyaluronan Agent
         i. Leflunomide and Derivatives
         ii. Hyaluronan Degrading Enzyme
   3. Combination Treatment
      Anti-Cancer Agents and Other Treatments
   4. Packaging and Articles of Manufacture G. METHODS OF ASSESSING ACTIVITY AND EFFECTS OF ANTI-HYALURONAN AGENTS AND CORTICOSTEROIDS
  1. Methods to Assess Side Effects
  2. Anti-Hyaluronan Activity
    a. Assays to Assess the Activity of a Hyaluronan Degrading Enzyme
    b. Assays in Animal Models
    c. Assays in Humans
    d. Pharmacokinetics
H. USE OF ANTI-HYALURONAN AGENTS IN TREATING HYALURONAN-ASSOCIATED CONDITIONS, DISEASES AND DISORDERS
  1. Selection of Subjects for Treatment And Assessing Treatment Effects
    a. Assays for detection of Hyaluronan-Associated Disease Markers
    b. Detection of Hyaluronan-Associated Markers Relative to Control Samples
  2. Use in Treating Cancers
I. EXAMPLES A. Definitions Unless defined otherwise, all technical and scientific terms used herein have the same meaning as is commonly understood by one of skill in the art to which the invention(s) belongs/belong. All patents, patent applications, published applications and publications, Genbank sequences, databases, websites and other published materials referred to throughout the entire disclosure herein, unless noted otherwise, are incorporated by reference in their entirety. In the event that there are a plurality of definitions for terms herein, those in this section prevail. Where reference is made to a URL or other such identifier or address, it understood that such identifiers can change and particular information on the internet can come and go, but equivalent information can be found by searching the internet. Reference thereto evidences the availability and public dissemination of such information.

As used herein, "adverse effect" or "side effect" refers to a harmful, deleterious and/or undesired effect of administering an anti-hyaluronan agent, such as a PEGylated hyaluronan degrading enzyme, such as PEGPH20 to a subject. Exemplary of side effects are musculoskeletal side effects. Side effects or adverse effects are graded on toxicity and various toxicity scales exist providing definitions for each grade. Exemplary of such scales are toxicity scales of the National Cancer Institute Common Toxicity Criteria version 2.0, the World Health Organization or Common Terminology Criteria for Adverse Events (CTCAE) scale. Generally, the scale is as follows: Grade 1=mild side effects; Grade 2=moderate side effects; Grade 3=Severe side effects; Grade 4=Life Threatening or Disabling side-effects; Grade 5=Fatal. Assigning grades of severity is within the experience of a physician or other health care professional.

As used herein, a dose-limiting toxicity (DLT) refers to the dose of a drug that produces side effects severe enough to prevent larger doses being given. It is within the level of skill of a skilled physician to assign or determine a DLT depending on the treatment protocol, the disease to be treated, the dosage regime and the particular patient to be treated. An exemplary definition of a DLT for treatment with an anti-hyaluronan agent treatment (in the absence of a corticosteroid or in its presence) is the dose in which an adverse event or side effect is observed that is related to the anti-hyaluronan treatment and that is defined on a toxicity scale of at least Grade 3 or higher and is a non-hematologic toxicity, or an ongoing or persistent Grade 2 toxicity that fails to resolve over the course of treatment and that limits the patient's ability to comply with the protocol therapy, or any Grade 4 or prolonged Grade 3 hematological toxicity. DLT's do not include nausea or vomiting that occurred without prophylactic anti-emetic therapy and that can be effectively treated with such therapy, or side effects that resolve on their own within a few hours to 24 hours.

As used herein, "musculoskeletal effect" or "musculoskeletal side effect" refers to effects on the system of muscles, tendons, ligaments, bones, joints and associated tissues. Musculoskeletal side effects include muscle and joint pain, stiffness of upper and lower extremities, cramping, myositis, muscle soreness and tenderness over the entire body, weakness, fatigue and a decrease in range of motion at knee and elbow joints. It is within the level of a skilled physician to assign grades of severity of observed or measured musculoskeletal side effects based on toxicity scales. It also is within the level of a skilled physician to assign a DLT to an observed musculoskeletal side effect.

As used herein, "ameliorating" or "reducing" a side effect or adverse event, or variations thereof, refers to lessening adverse effects or side effects, whether permanent or temporary, lasting or transient. For purposes herein, a side effect of an administered anti-hyaluronan agent, such as a musculoskeletal side effect, is deemed ameliorated by a corticosteroid when there is a reduction or lessening in the grade of severity measured on a toxicity scale for the side effect in the presence of the corticosteroid compared to in its absence. In one example, a side effect is ameliorated when the observed or measured toxicity of an administered anti-hyaluronan agent (observed following single dosage administration, multiple dosage administration or by virtue of the dosage regime) of Grade 3 or higher is reduced to a Grade 1 or Grade 2 in the presence of a corticosteroid. In another example, a side effect is ameliorated when the DLT of an administered anti-hyaluronan agent is eliminated or increased following administration of the corticosteroid. For example, a side effect is ameliorated when a DLT of 0.05 mg/mL from an administered anti-hyaluronan agent is eliminated or increased by administration of a corticosteroid to the subject, such that the same dose or higher dose of anti-hyaluronan agent can be administered with reduced side effect or when the DLT is increased to greater than 0.05 mg/mL, such as 0.5 mg/mL.

As used herein, "intravenous administration" refers to delivery of a therapeutic directly into a vein.

As used herein, an anti-hyaluronan agent refers to any agent that modulates hyaluronan (HA) synthesis or degradation, thereby altering hyaluronan levels in a tissue or cell. For purposes herein, anti-hyaluronan agents reduce hyaluronan levels in a tissue or cell compared to the absence of the agent. Such agents include compounds that modulate the expression of genetic material encoding HA synthase (HAS) and other enzymes or receptors involved in hyaluronan metabolism, or that modulate the proteins that synthesize or degrade hyaluronan including HAS function or activity. The agents include small-molecules, nucleic acids, peptides, proteins or other compounds. For example, anti-hyaluronan agents include, but are not limited to, antisense or sense molecules, antibodies, enzymes, small molecule inhibitors and HAS substrate analogs.

As used herein, a hyaluronan degrading enzyme refers to an enzyme that catalyzes the cleavage of a hyaluronan polymer (also referred to as hyaluronic acid or HA) into smaller molecular weight fragments. Exemplary of hyaluronan degrading enzymes are hyaluronidases, and particular chondroitinases and lyases that have the ability to depolymerize hyaluronan. Exemplary chondroitinases that are hyaluronan degrading enzymes include, but are not limited to, chondroitin ABC lyase (also known as chondroitinase ABC), chondroitin AC lyase (also known as chondroitin sulfate lyase or chondroitin sulfate eliminase) and chondroitin C lyase. Chondroitin ABC lyase comprises two enzymes, chondroitin-sulfate-ABC endolyase (EC 4.2.2.20) and chondroitin-sulfate-ABC exolyase (EC 4.2.2.21). An exemplary chondroitin-sulfate-ABC endolyases and chondroitin-sulfate-ABC exolyases include, but are not limited to, those from *Proteus vulgaris* and *Flavobacterium heparinum* (the *Proteus vulgaris* chondroitin-sulfate-ABC endolyase is set forth in SEQ ID NO:98; Sato et al. (1994) *Appl. Microbiol. Biotechnol.* 41(1):39-46). Exemplary chondroitinase AC enzymes from the bacteria include, but are not limited to, those from *Flavobacterium heparinum Victivallis vadensis*, set forth in SEQ ID NO:99, and *Arthrobacter aurescens* (Tkalec et al. (2000) *Applied and Environmental Microbiology* 66(1):29-35; Ernst et al. (1995) *Critical Reviews in Biochemistry and Molecular Biology* 30(5):387-444). Exemplary chondroitinase C enzymes from the bacteria include, but are not limited to, those from *Streptococcus* and *Flavobacterium* (Hibi et al. (1989) *FEMS-Microbiol-Lett.* 48(2):121-4; Michelacci et al. (1976) *J. Biol. Chem.* 251: 1154-8; Tsuda et al. (1999) *Eur. J. Biochem.* 262:127-133).

As used herein, hyaluronidase refers to a class of hyaluronan degrading enzymes. Hyaluronidases include bacterial hyaluronidases (EC 4.2.2.1 or EC 4.2.99.1), hyaluronidases from leeches, other parasites, and crustaceans (EC 3.2.1.36), and mammalian-type hyaluronidases (EC 3.2.1.35). Hyaluronidases include any of non-human origin including, but not limited to, murine, canine, feline, leporine, avian, bovine, ovine, porcine, equine, piscine, ranine, bacterial, and any from leeches, other parasites, and crustaceans. Exemplary non-human hyaluronidases include, hyaluronidases from cows (SEQ ID NOS:10, 11, 64 and BH55 (U.S. Pat. Nos. 5,747,027 and 5,827,721), yellow jacket wasp (SEQ ID NOS:12 and 13), honey bee (SEQ ID NO:14), white-face hornet (SEQ ID NO:15), paper wasp (SEQ ID NO:16), mouse (SEQ ID NOS:17-19, 32), pig (SEQ ID NOS:20-21), rat (SEQ ID NOS:22-24, 31), rabbit (SEQ ID NO:25), sheep (SEQ ID NOS:26, 27, 63 and 65), chimpanzee (SEQ ID NO:101), Rhesus monkey (SEQ ID NO:102), orangutan (SEQ ID NO:28), cynomolgus monkey (SEQ ID NO:29), guinea pig (SEQ ID NO:30), *Arthrobacter* sp. (strain FB24) (SEQ ID NO:67), *Bdellovibrio bacteriovorus* (SEQ ID NO:68), *Propionibacterium acnes* (SEQ ID NO:69), *Streptococcus agalactiae* ((SEQ ID NO:70); 18RS21 (SEQ ID NO:71); serotype Ia (SEQ ID NO:72); serotype III (SEQ ID NO:73), *Staphylococcus aureus* (strain COL (SEQ ID NO:74); strain MRSA252 (SEQ ID NOS:75 and 76); strain MSSA476 (SEQ ID NO:77); strain NCTC 8325 (SEQ ID NO:78); strain bovine RF122 (SEQ ID NOS:79 and 80); strain USA300 (SEQ ID NO:81), *Streptococcus pneumoniae* ((SEQ ID NO:82); strain ATCC BAA-255/R6 (SEQ ID NO:83); serotype 2, strain D39/NCTC 7466 (SEQ ID NO:84), *Streptococcus pyogenes* (serotype M1) (SEQ ID NO:85); serotype M2, strain MGAS10270 (SEQ ID NO:86); serotype M4, strain MGAS10750 (SEQ ID NO:87); serotype M6 (SEQ ID NO:88); serotype M12, strain MGAS2096 (SEQ ID NOS:89 and 90); serotype M12, strain MGAS9429 (SEQ ID NO:91); serotype M28 (SEQ ID NO:92); *Streptococcus suis* (SEQ ID NOS:93-95); *Vibrio fischeri* (strain ATCC 700601/ES114 (SEQ ID NO:96)), and the *Streptomyces hyaluronolyticus* hyaluronidase enzyme, which is specific for hyaluronic acid and does not cleave chondroitin or chondroitin sulfate (Ohya, T. and Kaneko, Y. (1970) *Biochim. Biophys. Acta* 198:607). Hyaluronidases also include those of human origin. Exemplary human hyaluronidases include HYAL1 (SEQ ID NO:36), HYAL2 (SEQ ID NO:37), HYAL3 (SEQ ID NO:38), HYAL4 (SEQ ID NO:39), and PH20 (SEQ ID NO:1). Also included amongst hyaluronidases are soluble hyaluronidases, including, ovine and bovine PH20, soluble human PH20 and soluble rHuPH20. Examples of commercially available bovine or ovine soluble hyaluronidases include Vitrase® (ovine hyaluronidase), Amphadase® (bovine hyaluronidase) and Hydase™ (bovine hyaluronidase).

As used herein, "purified bovine testicular hyaluronidase" refers to a bovine hyaluronidase purified from bovine testicular extracts (see U.S. Pat. Nos. 2,488,564, 2,488,565, 2,806,815, 2,808,362, 2,676,139, 2,795,529, 5,747,027 and 5,827,721). Examples of commercially available purified bovine testicular hyaluronidases include Amphadase® and Hydase™, and bovine hyaluronidases, including, but not limited to, those available from Sigma Aldrich, Abnova, EMD Chemicals, GenWay Biotech, Inc., Raybiotech, Inc., and Calzyme. Also included are recombinantly produced bovine hyaluronidases, such as but not limited to, those generated by expression of a nucleic acid molecule set forth in any of SEQ ID NOS:190-192.

As used herein, "purified ovine testicular hyaluronidase" refers to an ovine hyaluronidase purified from ovine testicular extracts (see U.S. Pat. Nos. 2,488,564, 2,488,565 and 2,806,815 and International PCT Application No. WO2005/118799). Examples of commercially available purified ovine testicular extract include Vitrase®, and ovine hyaluronidases, including, but not limited to, those available from Sigma Aldrich, Cell Sciences, EMD Chemicals, GenWay Biotech, Inc., Mybiosource.com and Raybiotech, Inc. Also included are recombinantly produced ovine hyaluronidases, such as, but not limited to, those generated by expression of a nucleic acid molecule set forth in any of SEQ ID NOS:66 and 193-194.

As used herein, "PH20" refers to a type of hyaluronidase that occurs in sperm and is neutral-active. PH-20 occurs on the sperm surface, and in the lysosome-derived acrosome, where it is bound to the inner acrosomal membrane. PH20 includes those of any origin including, but not limited to, human, chimpanzee, Cynomolgus monkey, Rhesus monkey, murine, bovine, ovine, guinea pig, rabbit and rat origin. Exemplary PH20 polypeptides include those from human (SEQ ID NO:1), chimpanzee (SEQ ID NO:101), Rhesus monkey (SEQ ID NO:102), Cynomolgus monkey (SEQ ID NO:29), cow (e.g., SEQ ID NOS:11 and 64), mouse (SEQ ID NO:32), rat (SEQ ID NO:31), rabbit (SEQ ID NO:25), sheep (SEQ ID NOS:27, 63 and 65) and guinea pig (SEQ ID NO:30).

Reference to hyaluronan degrading enzymes includes precursor hyaluronan degrading enzyme polypeptides and mature hyaluronan degrading enzyme polypeptides (such as those in which a signal sequence has been removed), truncated forms thereof that have activity, and includes allelic variants and species variants, variants encoded by splice variants, and other variants, including polypeptides that have at least 40%, 45%, 50%, 55%, 65%, 70%, 75%, 80%, 85%, 90%, 95%, 96%, 97%, 98%, 99% or more sequence identity to the precursor polypeptides set forth in SEQ ID NOS: 1 and 10-48, 63-65, 67-102, or the mature forms thereof. For example, reference to hyaluronan degrading enzyme also includes the human PH20 precursor polypeptide variants set forth in SEQ ID NOS:50-51. Hyaluronan degrading enzymes also include those that contain chemical or posttranslational modifications and those that do not contain chemical or posttranslational modifications. Such modifications include, but are not limited to, PEGylation, albumination, glycosylation, farnesylation, carboxylation, hydroxylation, phosphorylation, and other polypeptide modifications known in the art. A truncated PH20 hyaluronidase is any C-terminal shortened form thereof, particularly forms that are truncated and neutral active when N-glycosylated.

As used herein, a "soluble PH20" refers to any form of PH20 that is soluble under physiologic conditions. A soluble PH20 can be identified, for example, by its partitioning into the aqueous phase of a Triton® X-114 solution at 37° C. (Bordier et al., (1981) *J. Biol. Chem.*, 256:1604-7). Membrane-anchored PH20, such as lipid-anchored PH20, including GPI-anchored PH20, will partition into the detergent-rich phase, but will partition into the detergent-poor or aqueous phase following treatment with Phospholipase-C. Included among soluble PH20 are membrane-anchored PH20 in which one or more regions associated with anchoring of the PH20 to the membrane has been removed or modified, where the soluble form retains hyaluronidase activity. Soluble PH20 also includes recombinant soluble PH20 and those contained in or purified from natural sources, such as, for example, testes extracts from sheep or cows. Exemplary of such soluble PH20 is soluble human PH20.

As used herein, soluble human PH20 or sHuPH20 includes PH20 polypeptides lacking all or a portion of the glycosylphosphatidylinositol (GPI) anchor sequence at the C-terminus such that upon expression, the polypeptides are soluble under physiological conditions. Solubility can be assessed by any suitable method that demonstrates solubility under physiologic conditions. Exemplary of such methods is the Triton® X-114 assay, that assesses partitioning into the aqueous phase and that is described above and in the examples. In addition, a soluble human PH20 polypeptide is, if produced in CHO cells, such as CHO-S cells, a polypeptide that is expressed and is secreted into the cell culture medium. Soluble human PH20 polypeptides, however, are not limited to those produced in CHO cells, but can be produced in any cell or by any method, including recombinant expression and polypeptide synthesis. Reference to secretion by CHO cells is definitional. Hence, if a polypeptide could be expressed and secreted by CHO cells and is soluble, i.e. partitions into the aqueous phase when extracted with Triton® X-114, it is a soluble PH20 polypeptide whether or not it is so-produced. The precursor polypeptides for sHuPH20 polypeptides can include a signal sequence, such as a heterologous or non-heterologous (i.e. native) signal sequence. Exemplary of the precursors are those that include a signal sequence, such as the native 35 amino acid signal sequence at amino acid positions 1-35 (see, e.g., amino acids 1-35 of SEQ ID NO:1).

As used herein, an "extended soluble PH20" or "esPH20" includes soluble PH20 polypeptides that contain residues up to the GPI anchor-attachment signal sequence and one or more contiguous residues from the GPI-anchor attachment signal sequence such that the esPH20 is soluble under physiological conditions. Solubility under physiological conditions can be determined by any method known to those of skill in the art. For example, it can be assessed by the Triton® X-114 assay described above and in the examples. In addition, as discussed above, a soluble PH20 is, if produced in CHO cells, such as CHO-S cells, a polypeptide that is expressed and is secreted into the cell culture medium. Soluble human PH20 polypeptides, however, are not limited to those produced in CHO cells, but can be produced in any cell or by any method, including recombinant expression and polypeptide synthesis. Reference to secretion by CHO cells is definitional. Hence, if a polypeptide could be expressed and secreted by CHO cells and is soluble, i.e. partitions into the aqueous phase when extracted with Triton® X-114, it is a soluble PH20 polypeptide whether or not it is so-produced. Human soluble esPH20 polypeptides include, in addition to residues 36-490, one or more contiguous amino acids from amino acid residue position 491 of SEQ ID NO:1, inclusive, such that the resulting polypeptide is soluble. Exemplary human esPH20 soluble polypeptides are those that have amino acids residues corresponding to amino acids 36-491, 36-492, 36-493, 36-494, 36-495, 36-496 and 36-497 of SEQ ID NO:1. Exemplary of these are those with an amino acid sequence set forth in any of SEQ ID NOS:151-154 and 185-187. Also included are allelic variants and other variants, such as any with 40%, 45%, 50%, 55%, 65%, 70%, 75%, 80%, 85%, 90%, 91%, 92%, 93%, 94%, 95%, 96%, 97%, 98%, 99% or greater sequence identity with the corresponding polypeptides of SEQ ID NOS:151-154 and 185-187 that retain neutral activity and are soluble. Reference to sequence identity refers to variants with amino acid substitutions.

As used herein, reference to "esPH20s" includes precursor esPH20 polypeptides and mature esPH20 polypeptides (such as those in which a signal sequence has been removed), truncated forms thereof that have enzymatic activity (retaining at least 1%, 10%, 20%, 30%, 40%, 50% or more of the full-length form) and are soluble, and includes allelic variants and species variants, variants encoded by splice variants, and other variants, including polypeptides that have at least 40%, 45%, 50%, 55%, 65%, 70%, 75%, 80%, 85%, 90%, 91%, 92%, 93%, 94%, 95%, 96%, 97%, 98%, 99% or more sequence identity to the precursor polypeptides set forth in SEQ ID NOS:1 and 3, or the mature forms thereof.

As used herein, reference to "esPH20s" also include those that contain chemical or posttranslational modifications and those that do not contain chemical or posttranslational modifications. Such modifications include, but are not limited to, PEGylation, albumination, glycosylation, farnesylation, carboxylation, hydroxylation, phosphorylation, and other polypeptide modifications known in the art.

As used herein, "soluble recombinant human PH20 (rHuPH20)" refers to a composition containing solubles form of human PH20 as recombinantly expressed and secreted in Chinese Hamster Ovary (CHO) cells. Soluble rHuPH20 is encoded by nucleic acid molecule that includes the signal sequence and is set forth in SEQ ID NO:49. The nucleic acid encoding soluble rHuPH20 is expressed in CHO cells which secrete the mature polypeptide. As produced in the culture medium, there is heterogeneity at the C-terminus so that the product includes a mixture of species that can include any one or more of SEQ ID NO:4 to SEQ ID NO:9 in various abundance.

Similarly, for other forms of PH20, such as the esPH20s, recombinantly expressed polypeptides and compositions thereof can include a plurality of species whose C-terminus exhibits heterogeneity. For example, compositions of recombinantly expressed esPH20 produced by expression of the polypeptide of SEQ ID NO:107, which encodes an esPH20 that has amino acids 36-497, can include forms with fewer amino acids, such as 36-496, 36-495.

As used herein, an "N-linked moiety" refers to an asparagine (N) amino acid residue of a polypeptide that is capable of being glycosylated by post-translational modification of a polypeptide. Exemplary N-linked moieties of human PH20 include amino acids N82, N166, N235, N254, N368 and N393 of human PH20 set forth in SEQ ID NO:1.

As used herein, an "N-glycosylated polypeptide" refers to a PH20 polypeptide or truncated form thereto containing oligosaccharide linkage of at least three N-linked amino acid residues, for example, N-linked moieties corresponding to amino acid residues N235, N368 and N393 of SEQ ID NO:1. An N-glycosylated polypeptide can include a polypeptide where three, four, five and up to all of the N-linked moieties are linked to an oligosaccharide. The N-linked oligosaccharides can include oligomannose, complex, hybrid or sulfated oligosaccharides, or other oligosaccharides and monosaccharides.

As used herein, an "N-partially glycosylated polypeptide" refers to a polypeptide that minimally contains an N-acetylglucosamine glycan linked to at least three N-linked moieties. A partially glycosylated polypeptide can include various glycan forms, including monosaccharides, oligosaccharides, and branched sugar forms, including those formed by treatment of a polypeptide with EndoH, EndoF1, EndoF2 and/or EndoF3.

As used herein, a "deglycosylated PH20 polypeptide" refers to a PH20 polypeptide in which fewer than all possible glycosylation sites are glycosylated. Deglycosylation can be effected, for example, by removing glycosylation, by preventing it, or by modifying the polypeptide to eliminate a glycosylation site. Particular N-glycosylation sites are not required for activity, whereas others are.

As used herein, "PEGylated" refers to covalent or other stable attachment of polymeric molecules, such as polyethylene glycol (PEGylation moiety PEG) to hyaluronan degrading enzymes, such as hyaluronidases, typically to increase half-life of the hyaluronan degrading enzyme.

As used herein, a "conjugate" refers to a polypeptide linked directly or indirectly to one or more other polypeptides or chemical moieties. Such conjugates include fusion proteins, those produced by chemical conjugates and those produced by any other methods. For example, a conjugate refers to soluble PH20 polypeptides linked directly or indirectly to one or more other polypeptides or chemical moieties, whereby at least one soluble PH20 polypeptide is linked, directly or indirectly to another polypeptide or chemical moiety so long as the conjugate retains hyaluronidase activity.

As used herein, a "fusion" protein refers to a polypeptide encoded by a nucleic acid sequence containing a coding sequence from one nucleic acid molecule and the coding sequence from another nucleic acid molecule in which the coding sequences are in the same reading frame such that when the fusion construct is transcribed and translated in a host cell, the protein is produced containing the two proteins. The two molecules can be adjacent in the construct or separated by a linker polypeptide that contains, 1, 2, 3, or more, but typically fewer than 10, 9, 8, 7, or 6 amino acids. The protein product encoded by a fusion construct is referred to as a fusion polypeptide.

As used herein, a "polymer" refers to any high molecular weight natural or synthetic moiety that is conjugated to, i.e. stably linked directly or indirectly via a linker, to a polypeptide. Such polymers, typically increase serum half-life, and include, but are not limited to sialic moieties, PEGylation moieties, dextran, and sugar and other moieties, such as glycosylation. For example, hyaluronidases, such as a soluble PH20 or rHuPH20, can be conjugated to a polymer.

As used herein, a hyaluronidase substrate refers to a substrate (e.g. protein or polysaccharide) that is cleaved and/or depolymerized by a hyaluronidase enzyme. Generally, a hyaluronidase substrate is a glycosaminoglycan. An exemplary hyaluronidase substrate is hyaluronan (HA).

As used herein, a hyaluronan-associated disease, disorder or condition refers to any disease or condition in which hyaluronan levels are elevated as cause, consequence or otherwise observed in the disease or condition. Hyaluronan-associated diseases and conditions are associated with elevated hyaluronan expression in a tissue or cell, increased interstitial fluid pressure, decreased vascular volume, and/or increased water content in a tissue. Hyaluronan-associated diseases, disorders or conditions can be treated by administration of a composition containing an anti-hyaluronan agent, such as a hyaluronan degrading enzyme, such as a hyaluronidase, for example, a soluble hyaluronidase, either alone or in combination with or in addition to another treatment and/or agent. Exemplary diseases and conditions, include, but are not limited to, inflammatory diseases and hyaluronan-rich cancers. Hyaluronan rich cancers include, for example, tumors, including solid tumors such as late-stage cancers, a metastatic cancers, undifferentiated cancers, ovarian cancer, in situ carcinoma (ISC), squamous cell carcinoma (SCC), prostate cancer, pancreatic cancer, non-small cell lung cancer, breast cancer, colon cancer and other cancers. Also exemplary of hyaluronan-associated diseases and conditions are diseases that are associated with elevated interstitial fluid pressure, such as diseases associated with disc pressure, and edema, for example, edema caused by organ transplant, stroke, brain trauma or other injury. Exemplary hyaluronan-associated diseases and conditions include diseases and conditions associated with elevated interstitial fluid pressure, decreased vascular volume, and/or increased water content in a tissue, including cancers, disc pressure and edema. In one example, treatment of the hyaluronan-associated condition, disease or disorder includes amelioration, reduction, or other beneficial effect on one or more of increased interstitial fluid pressure (IFP), decreased vascular volume, and increased water content in a tissue.

As used herein, elevated hyaluronan levels refers to amounts of hyaluronan in a particular tissue, body fluid or cell, dependent upon the disease or condition. For example, as a consequence of the presence of a hyaluronan-rich tumor, hyaluronan (HA) levels can be elevated in body fluids, such as blood, urine, saliva and serum, and/or in the tumorous tissue or cell. The level can be compared to a standard or other suitable control, such as a comparable sample from a subject who does not have the HA-associated disease.

As used herein, specific activity refers to Units of activity per mg protein. The milligrams of hyaluronidase is defined by the absorption of a solution of at 280 nm assuming a molar extinction coefficient of approximately 1.7, in units of $M^{-1}$ $cm^{-1}$.

As used herein, elevated hyaluronan levels refers to amounts of hyaluronan in a particular tissue, body fluid or cell, dependent upon the disease or condition. For example, as a consequence of the presence of a hyaluronan-rich tumor, hyaluronan (HA) levels can be elevated in body fluids, such as blood, urine, saliva and serum, and/or in the tumorous tissue or cell. The level can be compared to a standard or other suitable control, such as a comparable sample from a subject who does not have the HA-associated disease.

As used herein, "activity" refers to a functional activity or activities of a polypeptide or portion thereof associated with a full-length (complete) protein. For example, active fragments of a polypeptide can exhibit an activity of a full-length protein. Functional activities include, but are not limited to, biological activity, catalytic or enzymatic activity, antigenicity (ability to bind or compete with a polypeptide for binding to an anti-polypeptide antibody), immunogenicity, ability to form multimers, and the ability to specifically bind to a receptor or ligand for the polypeptide.

As used herein, "hyaluronidase activity" refers to the ability to enzymatically catalyze the cleavage of hyaluronic acid. The United States Pharmacopeia (USP) XXII assay for hyaluronidase determines hyaluronidase activity indirectly by measuring the amount of higher molecular weight hyaluronic acid, or hyaluronan, (HA) substrate remaining after the enzyme is allowed to react with the HA for 30 min at 37° C. (USP XXII-NF XVII (1990) 644-645 United States Pharmacopeia Convention, Inc, Rockville, Md.). A Reference Standard solution can be used in an assay to ascertain the relative activity, in units, of any hyaluronidase. In vitro assays to determine the hyaluronidase activity of hyaluronidases, such as PH20, including soluble PH20 and esPH20, are known in the art and described herein. Exemplary assays include the microturbidity assay that measures cleavage of hyaluronic acid by hyaluronidase indirectly by detecting the insoluble precipitate formed when the uncleaved hyaluronic acid binds with serum albumin and the biotinylated-hyaluronic acid assay that measures the cleavage of hyaluronic acid indirectly by detecting the remaining biotinylated-hyaluronic acid non-covalently bound to microtiter plate wells with a streptavidin-horseradish peroxidase conjugate and a chromogenic substrate. Reference Standards can be used, for example, to generate a standard curve to determine the activity in Units of the hyaluronidase being tested.

As used herein, "neutral active" refers to the ability of a PH20 polypeptide to enzymatically catalyze the cleavage of hyaluronic acid at neutral pH (e.g. at or about pH 7.0). Generally, a neutral active and soluble PH20, e.g., C-terminally truncated or N-partially glycosylated PH20, has or has about 30%, 40%, 50%, 60%, 70%, 80%, 90%, 91%, 92%, 93%, 94%, 95%, 96%, 97%, 98%, 99%, 100%, 110%, 120%, 130%, 140%, 150%, 200%, 300%, 400%, 500%, 1000% or more activity compared to the hyaluronidase activity of a corresponding neutral active PH20 that is not C-terminally truncated or N-partially glycosylated.

As used herein, a "GPI-anchor attachment signal sequence" is a C-terminal sequence of amino acids that directs addition of a preformed GPI-anchor to the polypeptide within the lumen of the ER. GPI-anchor attachment signal sequences are present in the precursor polypeptides of GPI-anchored polypeptides, such as GPI-anchored PH20 polypeptides. The C-terminal GPI-anchor attachment signal sequence typically contains a predominantly hydrophobic region of 8-20 amino acids, preceded by a hydrophilic spacer region of 8-12 amino acids, immediately downstream of the ω-site, or site of GPI-anchor attachment. GPI-anchor attachment signal sequences can be identified using methods well known in the art. These include, but are not limited to, in silico methods and algorithms (see, e.g. Udenfriend et al. (1995) *Methods Enzymol.* 250:571-582, Eisenhaber et al., (1999) *J. Biol. Chem.* 292: 741-758, Fankhauser et al., (2005) *Bioinformatics* 21:1846-1852, Omaetxebarria et al., (2007) *Proteomics* 7:1951-1960, Pierleoni et al., (2008) BMC Bioinformatics 9:392), including those that are readily available on bioinformatic websites, such as the ExPASy Proteomics tools site (e.g., the WorldWideWeb site expasy.ch/tools/).

As used herein, "nucleic acids" include DNA, RNA and analogs thereof, including peptide nucleic acids (PNA) and mixtures thereof. Nucleic acids can be single or double-stranded. When referring to probes or primers, which are optionally labeled, such as with a detectable label, such as a fluorescent or radiolabel, single-stranded molecules are contemplated. Such molecules are typically of a length such that their target is statistically unique or of low copy number (typically less than 5, generally less than 3) for probing or priming a library. Generally a probe or primer contains at least 14, 16 or 30 contiguous nucleotides of sequence complementary to or identical to a gene of interest. Probes and primers can be 10, 20, 30, 50, 100 or more nucleic acids long.

As used herein, a peptide refers to a polypeptide that is greater than or equal to 2 amino acids in length, and less than or equal to 40 amino acids in length.

As used herein, the amino acids which occur in the various sequences of amino acids provided herein are identified according to their known, three-letter or one-letter abbreviations (Table 1). The nucleotides which occur in the various nucleic acid fragments are designated with the standard single-letter designations used routinely in the art.

As used herein, an "amino acid" is an organic compound containing an amino group and a carboxylic acid group. A polypeptide contains two or more amino acids. For purposes herein, amino acids include the twenty naturally-occurring amino acids, non-natural amino acids and amino acid analogs (i.e., amino acids wherein the α-carbon has a side chain).

As used herein, "amino acid residue" refers to an amino acid formed upon chemical digestion (hydrolysis) of a polypeptide at its peptide linkages. The amino acid residues described herein are presumed to be in the "L" isomeric form. Residues in the "D" isomeric form, which are so designated, can be substituted for any L-amino acid residue as long as the desired functional property is retained by the polypeptide. NH2 refers to the free amino group present at the amino terminus of a polypeptide. COOH refers to the free carboxy group present at the carboxyl terminus of a polypeptide. In keeping with standard polypeptide nomenclature described in J. Biol. Chem., 243: 3557-3559 (1968), and adopted 37 C.F.R. §§1.821-1.822, abbreviations for amino acid residues are shown in Table 1:

TABLE 1

Table of Correspondence

| SYMBOL | | |
|---|---|---|
| 1-Letter | 3-Letter | AMINO ACID |
| Y | Tyr | Tyrosine |
| G | Gly | Glycine |
| F | Phe | Phenylalanine |
| M | Met | Methionine |
| A | Ala | Alanine |
| S | Ser | Serine |
| I | Ile | Isoleucine |
| L | Leu | Leucine |
| T | Thr | Threonine |
| V | Val | Valine |
| P | Pro | Proline |
| K | Lys | Lysine |
| H | His | Histidine |
| Q | Gln | Glutamine |
| E | Glu | Glutamic acid |
| Z | Glx | Glu and/or Gln |
| W | Trp | Tryptophan |
| R | Arg | Arginine |
| D | Asp | Aspartic acid |
| N | Asn | Asparagine |
| B | Asx | Asn and/or Asp |
| C | Cys | Cysteine |
| X | Xaa | Unknown or other |

All amino acid residue sequences represented herein by formulae have a left to right orientation in the conventional direction of amino-terminus to carboxyl-terminus. In addition, the phrase "amino acid residue" is defined to include the amino acids listed in the Table of Correspondence (Table 1) and modified and unusual amino acids, such as those referred to in 37 C.F.R. §§1.821-1.822, and incorporated herein by reference. Furthermore, it should be noted that a dash at the beginning or end of an amino acid residue sequence indicates a peptide bond to a further sequence of one or more amino acid residues, to an amino-terminal group such as $NH_2$ or to a carboxyl-terminal group such as COOH.

As used herein, the "naturally occurring α-amino acids" are the residues of those 20α-amino acids found in nature which are incorporated into protein by the specific recognition of the charged tRNA molecule with its cognate mRNA codon in humans. Non-naturally occurring amino acids thus include, for example, amino acids or analogs of amino acids other than the 20 naturally-occurring amino acids and include, but are not limited to, the D-isostereomers of amino acids. Exemplary non-natural amino acids are described herein and are known to those of skill in the art.

As used herein, a DNA construct is a single- or double-stranded, linear or circular DNA molecule that contains segments of DNA combined and juxtaposed in a manner not found in nature. DNA constructs exist as a result of human manipulation, and include clones and other copies of manipulated molecules.

As used herein, a DNA segment is a portion of a larger DNA molecule having specified attributes. For example, a DNA segment encoding a specified polypeptide is a portion of a longer DNA molecule, such as a plasmid or plasmid fragment, which, when read from the 5' to 3' direction, encodes the sequence of amino acids of the specified polypeptide.

As used herein, the term polynucleotide means a single- or double-stranded polymer of deoxyribonucleotides or ribonucleotide bases read from the 5' to the 3' end. Polynucleotides include RNA and DNA, and can be isolated from natural sources, synthesized in vitro, or prepared from a combination of natural and synthetic molecules. The length of a polynucleotide molecule is given herein in terms of nucleotides (abbreviated "nt") or base pairs (abbreviated "bp"). The term nucleotides is used for single- and double-stranded molecules where the context permits. When the term is applied to double-stranded molecules it is used to denote overall length and will be understood to be equivalent to the term base pairs. It will be recognized by those skilled in the art that the two strands of a double-stranded polynucleotide can differ slightly in length and that the ends thereof can be staggered; thus all nucleotides within a double-stranded polynucleotide molecule may not be paired. Such unpaired ends will, in general, not exceed 20 nucleotides in length.

As used herein, "similarity" between two proteins or nucleic acids refers to the relatedness between the sequence of amino acids of the proteins or the nucleotide sequences of the nucleic acids. Similarity can be based on the degree of identity and/or homology of sequences of residues and the residues contained therein. Methods for assessing the degree of similarity between proteins or nucleic acids are known to those of skill in the art. For example, in one method of assessing sequence similarity, two amino acid or nucleotide sequences are aligned in a manner that yields a maximal level of identity between the sequences. "Identity" refers to the extent to which the amino acid or nucleotide sequences are invariant. Alignment of amino acid sequences, and to some extent nucleotide sequences, also can take into account conservative differences and/or frequent substitutions in amino acids (or nucleotides). Conservative differences are those that preserve the physico-chemical properties of the residues involved. Alignments can be global (alignment of the compared sequences over the entire length of the sequences and including all residues) or local (the alignment of a portion of the sequences that includes only the most similar region or regions).

"Identity" per se has an art-recognized meaning and can be calculated using published techniques. (See, e.g. Computational Molecular Biology, Lesk, A. M., ed., Oxford University Press, New York, 1988; Biocomputing: Informatics and Genome Projects, Smith, D. W., ed., Academic Press, New York, 1993; Computer Analysis of Sequence Data, Part I, Griffin, A. M., and Griffin, H. G., eds., Humana Press, New Jersey, 1994; Sequence Analysis in Molecular Biology, von Heinje, G., Academic Press, 1987; and Sequence Analysis Primer, Gribskov, M. and Devereux, J., eds., M Stockton Press, New York, 1991). While there exists a number of methods to measure identity between two polynucleotide or polypeptides, the term "identity" is well known to skilled artisans (Carrillo, H. & Lipton, D., SIAM J Applied Math 48:1073 (1988)).

As used herein, homologous (with respect to nucleic acid and/or amino acid sequences) means about greater than or equal to 25% sequence homology, typically greater than or equal to 25%, 40%, 50%, 60%, 70%, 80%, 85%, 90% or 95% sequence homology; the precise percentage can be specified if necessary. For purposes herein the terms "homology" and "identity" are often used interchangeably, unless otherwise indicated. In general, for determination of the percentage homology or identity, sequences are aligned so that the highest order match is obtained (see, e.g.: Computational Molecular Biology, Lesk, A. M., ed., Oxford University Press, New York, 1988; Biocomputing: Informatics and Genome Projects, Smith, D. W., ed., Academic Press, New York, 1993; Computer Analysis of Sequence Data, Part I, Griffin, A. M., and Griffin, H. G., eds., Humana Press, New Jersey, 1994; Sequence Analysis in Molecular Biology, von Heinje, G., Academic Press, 1987; and Sequence Analysis Primer, Gribskov, M. and Devereux, J., eds., M Stockton Press, New York, 1991; Carrillo et al. (1988) *SIAM J Applied Math* 48:1073). By sequence homology, the number of conserved amino acids is determined by standard alignment algorithms programs, and can be used with default gap penalties established by each supplier. Substantially homologous nucleic acid molecules would hybridize typically at moderate stringency or at high stringency all along the length of the nucleic acid of interest. Also contemplated are nucleic acid molecules that contain degenerate codons in place of codons in the hybridizing nucleic acid molecule.

Whether any two molecules have nucleotide sequences or amino acid sequences that are at least 60%, 70%, 80%, 85%, 90%, 95%, 96%, 97%, 98% or 99% "identical" or "homologous" can be determined using known computer algorithms such as the "FASTA" program, using for example, the default parameters as in Pearson et al. (1988) *Proc. Natl. Acad. Sci. USA* 85:2444 (other programs include the GCG program package (Devereux, J., et al., *Nucleic Acids Research* 12(I):387 (1984)), BLASTP, BLASTN, FASTA (Altschul, S. F., et al., *J Mol Biol* 215:403 (1990)); Guide to Huge Computers, Martin J. Bishop, ed., Academic Press, San Diego, 1994, and Carrillo et al. (1988) *SIAM J Applied Math* 48:1073). For example, the BLAST function of the National Center for Biotechnology Information database can be used to determine identity. Other commercially or publicly available programs include, DNAStar "MegAlign" program (Madison, Wis.) and the University of Wisconsin Genetics Computer Group (UWG) "Gap" program (Madison Wis.). Percent homology or identity of proteins and/or nucleic acid molecules can be determined, for example, by comparing sequence information using a GAP computer program (e.g., Needleman et al. (1970) J. Mol. Biol. 48:443, as revised by Smith and Waterman ((1981) Adv. Appl. Math. 2:482). Briefly, the GAP program defines similarity as the number of aligned symbols (i.e., nucleotides or amino acids), which are similar, divided by the total number of symbols in the shorter of the two sequences. Default parameters for the GAP program can include: (1) a unary comparison matrix (containing a value of 1 for identities and 0 for non-identities) and the weighted comparison matrix of Gribskov et al. (1986) *Nucl. Acids Res.* 14:6745, as described by Schwartz and Dayhoff, eds., ATLAS OF PROTEIN SEQUENCE AND STRUCTURE, National Biomedical Research Foundation, pp. 353-358 (1979); (2) a penalty of 3.0 for each gap and an additional 0.10 penalty for each symbol in each gap; and (3) no penalty for end gaps.

Therefore, as used herein, the term "identity" or "homology" represents a comparison between a test and a reference polypeptide or polynucleotide. As used herein, the term at least "90% identical to" refers to percent identities from 90 to 99.99 relative to the reference nucleic acid or amino acid sequence of the polypeptide. Identity at a level of 90% or more is indicative of the fact that, assuming for exemplification purposes a test and reference polypeptide length of 100 amino acids are compared. No more than 10% (i.e., 10 out of 100) of the amino acids in the test polypeptide differs from that of the reference polypeptide. Similar comparisons can be made between test and reference polynucleotides. Such differences can be represented as point mutations randomly distributed over the entire length of a polypeptide or they can be clustered in one or more locations of varying length up to the maximum allowable, e.g. 10/100 amino acid difference (approximately 90% identity). Differences are defined as nucleic acid or amino acid substitutions, insertions or deletions. At the level of homologies or identities above about 85-90%, the result should be independent of the program and gap parameters set; such high levels of identity can be assessed readily, often by manual alignment without relying on software.

As used herein, an aligned sequence refers to the use of homology (similarity and/or identity) to align corresponding positions in a sequence of nucleotides or amino acids. Typically, two or more sequences that are related by 50% or more identity are aligned. An aligned set of sequences refers to 2 or more sequences that are aligned at corresponding positions and can include aligning sequences derived from RNAs, such as ESTs and other cDNAs, aligned with genomic DNA sequence.

As used herein, "primer" refers to a nucleic acid molecule that can act as a point of initiation of template-directed DNA synthesis under appropriate conditions (e.g., in the presence of four different nucleoside triphosphates and a polymerization agent, such as DNA polymerase, RNA polymerase or reverse transcriptase) in an appropriate buffer and at a suitable temperature. It will be appreciated that certain nucleic acid molecules can serve as a "probe" and as a "primer." A primer, however, has a 3' hydroxyl group for extension. A primer can be used in a variety of methods, including, for example, polymerase chain reaction (PCR), reverse-transcriptase (RT)-PCR, RNA PCR, LCR, multiplex PCR, panhandle PCR, capture PCR, expression PCR, 3' and 5' RACE, in situ PCR, ligation-mediated PCR and other amplification protocols.

As used herein, "primer pair" refers to a set of primers that includes a 5' (upstream) primer that hybridizes with the 5' end of a sequence to be amplified (e.g. by PCR) and a 3' (downstream) primer that hybridizes with the complement of the 3' end of the sequence to be amplified.

As used herein, "specifically hybridizes" refers to annealing, by complementary base-pairing, of a nucleic acid molecule (e.g. an oligonucleotide) to a target nucleic acid molecule. Those of skill in the art are familiar with in vitro and in vivo parameters that affect specific hybridization, such as length and composition of the particular molecule. Parameters particularly relevant to in vitro hybridization further include annealing and washing temperature, buffer composition and salt concentration. Exemplary washing conditions for removing non-specifically bound nucleic acid molecules at high stringency are 0.1×SSPE, 0.1% SDS, 65° C., and at medium stringency are 0.2×SSPE, 0.1% SDS, 50° C. Equivalent stringency conditions are known in the art. The skilled person can readily adjust these parameters to achieve specific hybridization of a nucleic acid molecule to a target nucleic acid molecule appropriate for a particular application. Complementary, when referring to two nucleotide sequences, means that the two sequences of nucleotides are capable of hybridizing, typically with less than 25%, 15% or 5% mismatches between opposed nucleotides. If necessary, the percentage of complementarity will be specified. Typically the two molecules are selected such that they will hybridize under conditions of high stringency.

As used herein, substantially identical to a product means sufficiently similar so that the property of interest is sufficiently unchanged so that the substantially identical product can be used in place of the product.

As used herein, it also is understood that the terms "substantially identical" or "similar" varies with the context as understood by those skilled in the relevant art.

As used herein, an allelic variant or allelic variation references any of two or more alternative forms of a gene occupying the same chromosomal locus. Allelic variation arises naturally through mutation, and can result in phenotypic polymorphism within populations. Gene mutations can be silent (no change in the encoded polypeptide) or can encode polypeptides having altered amino acid sequence. The term "allelic variant" also is used herein to denote a protein encoded by an allelic variant of a gene. Typically the reference form of the gene encodes a wildtype form and/or predominant form of a polypeptide from a population or single reference member of a species. Typically, allelic variants, which include variants between and among species typically have at least 80%, 90% or greater amino acid identity with a wildtype and/or predominant form from the same species; the degree of identity depends upon the gene and whether comparison is interspecies or intraspecies. Generally, intraspecies allelic variants have at least about 80%, 85%, 90% or 95% identity or greater with a wildtype and/or predominant form, including 96%, 97%, 98%, 99% or greater identity with a wildtype and/or predominant form of a polypeptide. Reference to an allelic variant herein generally refers to variations in proteins among members of the same species.

As used herein, "allele," which is used interchangeably herein with "allelic variant" refers to alternative forms of a gene or portions thereof. Alleles occupy the same locus or position on homologous chromosomes. When a subject has two identical alleles of a gene, the subject is said to be homozygous for that gene or allele. When a subject has two different alleles of a gene, the subject is said to be heterozygous for the gene. Alleles of a specific gene can differ from each other in a single nucleotide or several nucleotides, and can include modifications such as substitutions, deletions and insertions of nucleotides. An allele of a gene also can be a form of a gene containing a mutation.

As used herein, species variants refer to variants in polypeptides among different species, including different mammalian species, such as mouse and human. For example for PH20, exemplary of species variants provided herein are primate PH20, such as, but not limited to, human, chimpanzee, macaque and cynomologous monkey. Generally, species variants have 70%, 75%, 80%, 85%, 90%, 91%, 92%, 93%, 94%, 95%, 96%, 97%, 98% or sequence identity. Corresponding residues between and among species variants can be determined by comparing and aligning sequences to maximize the number of matching nucleotides or residues, for example, such that identity between the sequences is equal to or greater than 95%, equal to or greater than 96%, equal to or greater than 97%, equal to or greater than 98% or equal to greater than 99%. The position of interest is then given the number assigned in the reference nucleic acid molecule. Alignment can be effected manually or by eye, particularly, where sequence identity is greater than 80%.

As used herein, a human protein is one encoded by a nucleic acid molecule, such as DNA, present in the genome of a human, including all allelic variants and conservative variations thereof. A variant or modification of a protein is a human protein if the modification is based on the wildtype or prominent sequence of a human protein.

As used herein, a splice variant refers to a variant produced by differential processing of a primary transcript of genomic DNA that results in more than one type of mRNA.

As used herein, modification is in reference to modification of a sequence of amino acids of a polypeptide or a sequence of nucleotides in a nucleic acid molecule and includes deletions, insertions, and replacements (e.g. substitutions) of amino acids and nucleotides, respectively. Exemplary of modifications are amino acid substitutions. An amino-acid substituted polypeptide can exhibit 65%, 70%, 80%, 85%, 90%, 91%, 92%, 93%, 94%, 95%, 96%, 97%, 98% or more sequence identity to a polypeptide not containing the amino acid substitutions. Amino acid substitutions can be conservative or non-conservative. Generally, any modification to a polypeptide retains an activity of the polypeptide. Methods of modifying a polypeptide are routine to those of skill in the art, such as by using recombinant DNA methodologies.

As used herein, suitable conservative substitutions of amino acids are known to those of skill in the art and can be made generally without altering the biological activity of the resulting molecule. Those of skill in the art recognize that, in general, single amino acid substitutions in non-essential regions of a polypeptide do not substantially alter biological activity (see, e.g., Watson et al. Molecular Biology of the Gene, 4th Edition, 1987, The Benjamin/Cummings Pub. co., p. 224). Such substitutions can be made in accordance with those set forth in TABLE 2 as follows:

TABLE 2

| Original residue | Exemplary conservative substitution |
|---|---|
| Ala (A) | Gly; Ser |
| Arg (R) | Lys |
| Asn (N) | Gln; His |

TABLE 2-continued

| Original residue | Exemplary conservative substitution |
|---|---|
| Cys (C) | Ser |
| Gln (Q) | Asn |
| Glu (E) | Asp |
| Gly (G) | Ala; Pro |
| His (H) | Asn; Gln |
| Ile (I) | Leu; Val |
| Leu (L) | Ile; Val |
| Lys (K) | Arg; Gln; Glu |
| Met (M) | Leu; Tyr; Ile |
| Phe (F) | Met; Leu; Tyr |
| Ser (S) | Thr |
| Thr (T) | Ser |
| Trp (W) | Tyr |
| Tyr (Y) | Trp; Phe |
| Val (V) | Ile; Leu |

Other substitutions also are permissible and can be determined empirically or in accord with known conservative substitutions.

As used herein, the term promoter means a portion of a gene containing DNA sequences that provide for the binding of RNA polymerase and initiation of transcription. Promoter sequences are commonly, but not always, found in the 5' non-coding region of genes.

As used herein, isolated or purified polypeptide or protein or biologically-active portion thereof is substantially free of cellular material or other contaminating proteins from the cell or tissue from which the protein is derived, or substantially free from chemical precursors or other chemicals when chemically synthesized. Preparations can be determined to be substantially free if they appear free of readily detectable impurities as determined by standard methods of analysis, such as thin layer chromatography (TLC), gel electrophoresis and high performance liquid chromatography (HPLC), used by those of skill in the art to assess such purity, or sufficiently pure such that further purification would not detectably alter the physical and chemical properties, such as enzymatic and biological activities, of the substance. Methods for purification of the compounds to produce substantially chemically pure compounds are known to those of skill in the art. A substantially chemically pure compound, however, can be a mixture of stereoisomers. In such instances, further purification might increase the specific activity of the compound.

Hence, reference to a substantially purified polypeptide, such as a substantially purified soluble PH20. refers to preparations of proteins that are substantially free of cellular material includes preparations of proteins in which the protein is separated from cellular components of the cells from which it is isolated or recombinantly-produced. In one embodiment, the term substantially free of cellular material includes preparations of enzyme proteins having less that about 30% (by dry weight) of non-enzyme proteins (also referred to herein as a contaminating protein), generally less than about 20% of non-enzyme proteins or 10% of non-enzyme proteins or less that about 5% of non-enzyme proteins. When the enzyme protein is recombinantly produced, it also is substantially free of culture medium, i.e., culture medium represents less than about or at 20%, 10% or 5% of the volume of the enzyme protein preparation.

As used herein, the term substantially free of chemical precursors or other chemicals includes preparations of enzyme proteins in which the protein is separated from chemical precursors or other chemicals that are involved in the synthesis of the protein. The term includes preparations of enzyme proteins having less than about 30% (by dry weight), 20%, 10%, 5% or less of chemical precursors or non-enzyme chemicals or components.

As used herein, synthetic, with reference to, for example, a synthetic nucleic acid molecule or a synthetic gene or a synthetic peptide refers to a nucleic acid molecule or polypeptide molecule that is produced by recombinant methods and/or by chemical synthesis methods.

As used herein, production by recombinant means or using recombinant DNA methods means the use of the well known methods of molecular biology for expressing proteins encoded by cloned DNA.

As used herein, vector (or plasmid) refers to discrete elements that are used to introduce a heterologous nucleic acid into cells for either expression or replication thereof. The vectors typically remain episomal, but can be designed to effect integration of a gene or portion thereof into a chromosome of the genome. Also contemplated are vectors that are artificial chromosomes, such as yeast artificial chromosomes and mammalian artificial chromosomes. Selection and use of such vehicles are well known to those of skill in the art.

As used herein, an expression vector includes vectors capable of expressing DNA that is operatively linked with regulatory sequences, such as promoter regions, that are capable of effecting expression of such DNA fragments. Such additional segments can include promoter and terminator sequences, and optionally can include one or more origins of replication, one or more selectable markers, an enhancer, a polyadenylation signal. Expression vectors are generally derived from plasmid or viral DNA, or can contain elements of both. Thus, an expression vector refers to a recombinant DNA or RNA construct, such as a plasmid, a phage, recombinant virus or other vector that, upon introduction into an appropriate host cell, results in expression of the cloned DNA. Appropriate expression vectors are well known to those of skill in the art and include those that are replicable in eukaryotic cells and/or prokaryotic cells and those that remain episomal or those which integrate into the host cell genome.

As used herein, vector also includes "virus vectors" or "viral vectors." Viral vectors are engineered viruses that are operatively linked to exogenous genes to transfer (as vehicles or shuttles) the exogenous genes into cells.

As used herein, "operably" or "operatively linked" when referring to DNA segments means that the segments are arranged so that they function in concert for their intended purposes, e.g., transcription initiates downstream of the promoter and upstream of any transcribed sequences. The promoter is usually the domain to which the transcriptional machinery binds to initiate transcription and proceeds through the coding segment to the terminator.

As used herein the term "assessing" is intended to include quantitative and qualitative determination in the sense of obtaining an absolute value for the activity of a protein, such as an enzyme, or a domain thereof, present in the sample, and also of obtaining an index, ratio, percentage, visual or other value indicative of the level of the activity. Assessment can be direct or indirect. For example, the chemical species actually detected need not of course be the enzymatically cleaved product itself but can for example be a derivative thereof or some further substance. For example, detection of a cleavage product can be a detectable moiety such as a fluorescent moiety.

As used herein, biological activity refers to the in vivo activities of a compound or physiological responses that result upon in vivo administration of a compound, composition or other mixture. Biological activity, thus, encompasses therapeutic effects and pharmaceutical activity of such compounds, compositions and mixtures. Biological activities can be observed in in vitro systems designed to test or use such activities. Thus, for purposes herein a biological activity of a hyaluronidase enzyme is its degradation of hyaluronic acid.

As used herein equivalent, when referring to two sequences of nucleic acids, means that the two sequences in question encode the same sequence of amino acids or equivalent proteins. When equivalent is used in referring to two proteins or peptides, it means that the two proteins or peptides have substantially the same amino acid sequence with only amino acid substitutions that do not substantially alter the activity or function of the protein or peptide. When equivalent refers to a property, the property does not need to be present to the same extent (e.g., two peptides can exhibit different rates of the same type of enzymatic activity), but the activities are usually substantially the same.

As used herein, "modulate" and "modulation" or "alter" refer to a change of an activity of a molecule, such as a protein. Exemplary activities include, but are not limited to, biological activities, such as signal transduction. Modulation can include an increase in the activity (i.e., up-regulation or agonist activity), a decrease in activity (i.e., down-regulation or inhibition) or any other alteration in an activity (such as a change in periodicity, frequency, duration, kinetics or other parameter). Modulation can be context dependent and typically modulation is compared to a designated state, for example, the wildtype protein, the protein in a constitutive state, or the protein as expressed in a designated cell type or condition.

As used herein, a composition refers to any mixture. It can be a solution, suspension, liquid, powder, paste, aqueous, non-aqueous or any combination thereof.

As used herein, a combination refers to any association between or among two or more items. The combination can be two or more separate items, such as two compositions or two collections, can be a mixture thereof, such as a single mixture of the two or more items, or any variation thereof. The elements of a combination are generally functionally associated or related.

As used herein, "disease or disorder" refers to a pathological condition in an organism resulting from cause or condition including, but not limited to, infections, acquired conditions, genetic conditions, and characterized by identifiable symptoms. Diseases and disorders of interest herein are hyaluronan-associated diseases and disorders.

As used herein, "treating" a subject with a disease or condition means that the subject's symptoms are partially or totally alleviated, or remain static following treatment. Hence treatment encompasses prophylaxis, therapy and/or cure. Prophylaxis refers to prevention of a potential disease and/or a prevention of worsening of symptoms or progression of a disease.

As used herein, a pharmaceutically effective agent, includes any therapeutic agent or bioactive agents, including, but not limited to, for example, chemotherapeutics, anesthetics, vasoconstrictors, dispersing agents, conventional therapeutic drugs, including small molecule drugs and therapeutic proteins.

As used herein, treatment means any manner in which the symptoms of a condition, disorder or disease or other indication, are ameliorated or otherwise beneficially altered.

As used herein, therapeutic effect means an effect resulting from treatment of a subject that alters, typically improves or ameliorates the symptoms of a disease or condition or that cures a disease or condition. A therapeutically effective amount refers to the amount of a composition, molecule or compound which results in a therapeutic effect following administration to a subject.

As used herein, the term "subject" refers to an animal, including a mammal, such as a human being.

As used herein, a patient refers to a human subject exhibiting symptoms of a disease or disorder.

As used herein, about the same means within an amount that one of skill in the art would consider to be the same or to be within an acceptable range of error. For example, typically, for pharmaceutical compositions, within at least 1%, 2%, 3%, 4%, 5% or 10% is considered about the same. Such amount can vary depending upon the tolerance for variation in the particular composition by subjects.

As used herein, dosing regime refers to the amount of agent, for example, the composition containing an anti-hyaluronan agent, for example a soluble hyaluronidase or other agent, administered, and the frequency of administration. The dosing regime is a function of the disease or condition to be treated, and thus can vary.

As used herein, frequency of administration refers to the time between successive administrations of treatment. For example, frequency can be days, weeks or months. For example, frequency can be more than once weekly, for example, twice a week, three times a week, four times a week, five times a week, six times a week or daily. Frequency also can be one, two, three or four weeks. The particular frequency is function of the particular disease or condition treated. Generally, frequency is more than once weekly, and generally is twice weekly.

As used herein, a "cycle of administration" refers to the repeated schedule of the dosing regime of administration of the enzyme and/or a second agent that is repeated over successive administrations. For example, an exemplary cycle of administration is a 28 day cycle with administration twice weekly for three weeks, followed by one-week of discontinued dosing.

As used herein, when referencing dosage based on mg/kg of the subject, an average human subject is considered to have a mass of about 70 kg-75 kg, such as 70 kg.

As used herein, amelioration of the symptoms of a particular disease or disorder by a treatment, such as by administration of a pharmaceutical composition or other therapeutic, refers to any lessening, whether permanent or temporary, lasting or transient, of the symptoms or, adverse effects of a condition, such as, for example, reduction of adverse effects associated with or that occur upon administration of an anti-hyaluronan agent, such as a PEGylated hyaluronidase.

As used herein, prevention or prophylaxis refers to a reduction in the risk of developing a disease or condition.

As used herein, a "therapeutically effective amount" or a "therapeutically effective dose" refers to the quantity of an agent, compound, material, or composition containing a compound that is at least sufficient to produce a therapeutic effect. Hence, it is the quantity necessary for preventing, curing, ameliorating, arresting or partially arresting a symptom of a disease or disorder.

As used herein, unit dose form refers to physically discrete units suitable for human and animal subjects and packaged individually as is known in the art.

As used herein, a single dosage formulation refers to a formulation as a single dose.

As used herein, formulation for direct administration means that the composition does not require further dilution for administration.

As used herein, an "article of manufacture" is a product that is made and sold. As used throughout this application, the term is intended to encompass anti-hyaluronan agents, for example hyaluronan degrading enzyme, such as hyaluronidase, and second agent compositions contained in articles of packaging. For example, a second agent is a corticosteroid.

As used herein, fluid refers to any composition that can flow. Fluids thus encompass compositions that are in the form of semi-solids, pastes, solutions, aqueous mixtures, gels, lotions, creams and other such compositions.

As used herein, a combination, such as a combination of compositions provided herein, refers to an association of elements of the combination.

As used herein a kit refers to a combination of components, such as a combination of the compositions herein and another item for a purpose including, but not limited to, reconstitution, activation, and instruments/devices for delivery, administration, diagnosis, and assessment of a biological activity or property. Kits optionally include instructions for use.

As used herein, a cellular extract or lysate refers to a preparation or fraction which is made from a lysed or disrupted cell.

As used herein, animal includes any animal, such as, but are not limited to primates including humans, gorillas and monkeys; rodents, such as mice and rats; fowl, such as chickens; ruminants, such as goats, cows, deer, sheep; pigs and other animals. Non-human animals exclude humans as the contemplated animal. The hyaluronidases provided herein are from any source, animal, plant, prokaryotic and fungal. Most hyaluronidases are of animal origin, including mammalian origin. Generally hyaluronidases are of human origin.

As used herein, anti-cancer treatments include administration of drugs and other agents for treating cancer, and also treatment protocols, such as surgery and radiation. Anti-cancer treatments include administration of anti-cancer agents.

As used herein, an anti-cancer agent refers to any agents, or compounds, used in anti-cancer treatment. These include any agents, when used alone or in combination with other compounds, that can alleviate, reduce, ameliorate, prevent, or place or maintain in a state of remission of clinical symptoms or diagnostic markers associated with tumors and cancer, and can be used in combinations and compositions provided herein. Exemplary anti-cancer agents include, but are not limited to, anti-hyaluronan agents, such as the PEGylated hyaluronan degrading enzymes provided herein used singly or in combination and/or in combination with other anti-cancer agents, such as chemotherapeutics, polypeptides, antibodies, peptides, small molecules or gene therapy vectors, viruses or DNA.

As used herein, a control refers to a sample that is substantially identical to the test sample, except that it is not treated with a test parameter, or, if it is a plasma sample, it can be from a normal volunteer not affected with the condition of interest. A control also can be an internal control.

As used herein, the singular forms "a," "an" and "the" include plural referents unless the context clearly dictates otherwise. Thus, for example, reference to a compound comprising or containing "an extracellular domain" includes compounds with one or a plurality of extracellular domains.

As used herein, ranges and amounts can be expressed as "about" a particular value or range. About also includes the exact amount. Hence "about 5 bases" means "about 5 bases" and also "5 bases."

As used herein, "optional" or "optionally" means that the subsequently described event or circumstance does or does not occur, and that the description includes instances where said event or circumstance occurs and instances where it does not. For example, an optionally substituted group means that the group is unsubstituted or is substituted.

As used herein, the abbreviations for any protective groups, amino acids and other compounds, are, unless indicated otherwise, in accord with their common usage, recognized abbreviations, or the IUPAC-IUB Commission on Biochemical Nomenclature (see, (1972) *Biochem.* 11:1726).

B. Overview

1. Anti-Hyaluronan Agents and Hyaluronan-Associated Diseases, Conditions and/or Disorders Certain diseases are associated with expression and/or production of hyaluronan, including inflammatory diseases and cancers. HA is linked to a variety of biological processes involved with progression of such diseases (see e.g. Itano et al. (2008) Semin Cancer Biol 18(4):268-274; Tammi et al. (2008) Semin Cancer Biol 18(4):288-295). For example, HA is linked to biological processes associated with tumor progression, including epithelial-mesenchymal transition, and the p53 tumor suppressor pathway. Also, HA is involved in increased water uptake and interstitial fluid pressure (IFP) in disease tissues, such as tumors, thereby resulting in compressed tumor vasculature. For example, at sites of inflammation or in a tumor focus, there is rapid accumulation of hyaluronan, other matrix components and water. Because of this rapid accumulation, the diseased site cannot come to equilibrium with its environment and therefore has a higher interstitial fluid pressure than normal tissues.

Anti-hyaluronan agents reduce hyaluronic acid (HA; also referred to herein as hyaluronan) levels by interfering with its synthesis or increasing its degradation. For example, hyaluronan degrading enzymes, such as hyaluronidase, interfere with and degrade hyaluronic acid (HA). Treatment with agents that degrade or inhibit hyaluronan synthesis, such as hyaluronan degrading enzymes, reduce the hyaluronan such that the tissue deflates, the blood vessels expand, and more blood can flow through the site.

In addition, the IFP of most solid tumors and other diseased tissues associated with accumulated HA is elevated, acting as a barrier to efficient drug delivery (Heldin et al. (2004) Nat Rev Cancer 4(10):806-813). Thus, in addition to diminishing IFP and water content at the tissue site and associated increased vascular perfusion, anti-hyaluronan agents, such as hyaluronan degrading enzymes, also can enhance the activity of coadministered therapies. For example, anti-hyaluronan agents, such as hyaluronan degrading enzymes, can enhance the delivery of chemotherapeutic agents to tumors.

Hence, anti-hyaluronan agents, such as hyaluronan degrading enzymes, exhibit properties useful for single-agent or combination therapy of diseases and conditions that exhibit the accumulation of hyaluronan (hyaluronic acid, HA). Hyaluronan-associated diseases, conditions and/or disorders, include, cancers and inflammatory diseases. Hyaluronan-rich cancers include, but are not limited to, tumors, including solid tumors, for example, late-stage cancers, a metastatic cancers, undifferentiated cancers, ovarian cancer, in situ carcinoma (ISC), squamous cell carcinoma (SCC), prostate cancer, pancreatic cancer, non-small cell lung cancer, breast cancer, colon cancer and other cancers. Hyaluronidase has been shown to remove HA from tumors resulting in the reduction of tumor volume, the reduction of intratumoral interstitial pressure, the slowing of tumor cell proliferation, and the enhanced efficacy of co-administered chemotherapeutic drugs and biological agents by enabling increased tumor penetration (see e.g. U.S. published application No. 20100003238 and International published PCT Appl. No WO 2009/128917).

PEGylation is an established technology used to increase the half-life of therapeutic proteins in the body thus enabling their use in systemic treatment protocols. PEGylation of anti-hyaluronan agents, such as hyaluronan degrading enzymes, such as hyaluronidase extends its half-life in the body from less than a minute to approximately 48 to 72 hours and allows for the systemic treatment of tumors rich in HA (see e.g. U.S. published application No. 20100003238 and International published PCT Appl. No WO 2009/128917). The increased half-life relative to unPEGylated hyaluronidase, permits not only removal of HA, but also, due to its continued presence in the plasma and its ability to degrade HA, reduces or decreases the extent of regeneration of HA within diseased tissues, such as the tumor. Maintenance of plasma enzyme levels can remove HA, such as tumor HA, and also counteract HA resynthesis.

2. Adverse Effects Associated with Treatment with Anti-Hyaluronan Agents

The use of anti-hyaluronan agents, for example hyaluronan degrading enzymes, such as hyaluronidase, has not previously been observed to be associated with side effects. Nevertheless, as described herein, several species, including humans, developed musculoskeletal side effects after being dosed with PEGylated hyaluronidase, as observed in both preclinical and clinical studies (described herein below and in Examples 6-7). The musculoskeletal side effects included stiffness, muscle and joint pain, and a decrease in range of motion at knee and elbow joints.

Humans who received a single intravenous dose of 0.05 mg/kg PEGPH20 manifested adverse musculoskeletal symptoms approximately six hours after dosing. The adverse effects included one or more of the following effects: muscle and joint pain/stiffness of upper and lower extremities, cramping, muscle, myositis muscle soreness and tenderness over the entire body, weakness and fatigue. On the Common Terminology Criteria for Adverse Events (CTCAE) scale, symptoms were observed to reach Grade 3. The adverse effects resolved over several days once treatment was discontinued. Example 6 further exemplifies adverse events occurring in a sample of human patients treated with PEGPH20 under various dosage regimens, dose and dosing frequency. The severity of the musculoskeletal events appear to be influenced by the combination of PEGPH20 dose and dosing frequency. For example, the symptoms appear to be more severe with higher doses of PEGPH20 and a more frequent dosing schedule.

Monkeys who were administered PEGPH20 exhibited hypoactivity, lethargy, disorientation, hunched posture and a decrease in limb joint angle. Four weeks of a twice-weekly IV dosing with PEGPH20 resulted in a decrease in the range of motion at the knee and elbow joints. After dosing was discontinued, partial to full recovery was observed.

Beagle dogs that received a single dose of either 0.08 mg/kg PEGPH20 or 0.3 mg/kg PEGPH20 exhibited on the following day reduced walking ability, difficulty standing, decreased activity and tightness of the muscles of the neck, back and extremities. The animals completely recovered by day four after dosing was discontinued.

3. Use of Corticosteroids to Ameliorate the Adverse Effects of Anti-Hyaluronan Agents Provided herein are methods and uses to ameliorate or prevent adverse effects, such as musculoskeletal side effects, associated with treatment or administration with an anti-hyaluronan agent by premedication or co-medication with a corticosteroid. For example, as shown herein, the musculoskeletal side effects observed with systemic administration of PEGylated hyaluronidase can be ameliorated, and/or eliminated, by premedication and/or co-medication with a corticosteroid, e.g., a glucocorticoid such as dexamethasone. The result is an improved tolerability of higher PEGPH20 doses and dosing frequency combinations. Hence, as described herein, adverse events associated with single therapy or combination therapy PH20 treatment to treat a hyaluronan-associated disease or condition can be achieved in the presence of a corticosteroid.

Hence, provided herein are methods to ameliorate adverse effects associated with the use of an anti-hyaluronan agent, such as a PEGylated hyaluronan degrading enzyme, for single-agent or combination therapy of diseases and conditions which exhibit the accumulation of hyaluronan. The methods use corticosteroids, e.g., glucocorticoids, to ameliorate the adverse musculoskeletal side effects of treatment with anti-hyaluronan agents, such as PEGylated hyaluronan degrading enzymes. In some examples, the adverse side effects are reduced. In other examples, the adverse side effects are eliminated. Typically, the corticosteroid is administered orally, although any method of administration of the corticosteroid is contemplated. Typically, the glucocorticoid is administered at an amount between at or about 0.4 and 20 mgs, for example, at or about 0.4 mgs, 0.5 mgs, 0.6 mgs, 0.7 mgs, 0.75 mgs, 0.8 mgs, 0.9 mgs, 1 mg, 2 mgs, 3 mgs, 4 mgs, 5 mgs, 6 mgs, 7 mgs, 8 mgs, 9 mgs, 10 mgs, 11 mgs, 12 mgs, 13 mgs, 14 mgs, 15 mgs, 16 mgs, 17 mgs, 18 mgs, 19 mgs or 20 mgs per dose.

The corticosteroid can be administered before, after or concurrently with the anti-hyaluronan agents, such as a PEGylated hyaluronidase. In some examples, the corticosteroid is administered prior to the administration of the anti-hyaluronan agent, such as a PEGylated hyaluronan degrading enzyme. For example, the corticosteroid can be administered up to at or about 0.5 minutes, 1 minute, 2 minutes, 3 minutes, 4 minutes, 5 minutes, 6 minutes, 7 minutes, 8 minutes, 9 minutes, 10 minutes, 15 minutes, 20 minutes, 25 minutes, 30 minutes, 45 minutes, 1 hour, 2 hours, 3 hours, 4 hours, 5 hours, 6 hours, 7 hours, 8 hours, 9 hours, 10 hours, 11 hours, 12 hours, 18 hours, 24 hours, 36 hours or more prior to administration of the anti-hyaluronan agent, for example, a PEGylated hyaluronan degrading enzyme. In other examples, the corticosteroid is administered at the same time as administration of the anti-hyaluronan agent, for example a PEGylated hyaluronan degrading enzyme. In this example, the corticosteroid can be administered separately or together with the anti-hyaluronan agent. Typically, the corticosteroid is administered separately from the anti-hyaluronan agent. In other examples, the corticosteroid is administered subsequent to the administration of the anti-hyaluronan agent, for example a PEGylated hyaluronan degrading enzyme. For example, the corticosteroid can be administered up to at or about 0.5 minutes, 1 minute, 2 minutes, 3 minutes, 4 minutes, 5 minutes, 6 minutes, 7 minutes, 8 minutes, 9 minutes, 10 minutes, 15 minutes, 20 minutes, 25 minutes, 30 minutes, 45 minutes, 1 hour, 2 hours, 3 hours, 4 hours, 5 hours, 6 hours, 7 hours, 8 hours, 9 hours, 10 hours, 11 hours, 12 hours, 18 hours, 24 hours, 36 hours or more after the administration of the anti-hyaluronan agent, such as a PEGylated hyaluronan degrading enzyme.

In some examples, the corticosteroid is used in a dosing regimen where the anti-hyaluronan agent, for example a PEGylated hyaluronan degrading enzyme, is administered alone for treatment of a hyaluronan associated disease or condition. In other examples, the corticosteroid is used in a dosing regiment where the anti-hyaluronan agent, for example a PEGylated hyaluronan degrading enzymes, is administered in combination with one or more additional agents and/or treatment for treating the disease or disorder, for example, an anti-cancer agent, such as a chemotherapy, antibody, vector or nucleic acid for treating cancer. In this example, the second treatment or agent can be administered separately or together with the anti-hyaluronan agent. For example, the anti-hyaluronan agent, for example a PEGylated hyaluronan degrading enzyme or other modified hyaluonan-degrading enzyme, are administered before, after or with an additional agent or treatment. Hence, anti-hyaluronan agents, for example hyaluronan degrading enzymes, particularly modified hyaluronan degrading enzymes, such as PEGylated soluble hyaluronidases, can be administrated as therapeutic agents alone or in combination with other therapeutic agents.

C. Anti-Hyaluronan Agents

HA, also called hyaluronic acid, hyaluronate or hyaluronan, is a high molecular weight linear glycosaminoglycan that contains repeating disaccharide units, $\beta 1,3$ N-acetyl-D-glucosamine-linked $\beta 1,4$ to D-glucoronic acid. Hyaluronan is widely distributed throughout connective, epithelial, and neural tissues. It also is a major component of the extracellular matrix and a constituent of the interstitial barrier. For example, the extracellular matrix of cartilage contains a small amount of HA. HA plays a role in tissue remodeling during development and normal tissue homeostatis, and likely is involved in cell adhesion and migration. HA also functions as a biological lubricant in joints and is important both during movement and under static conditions (see e.g. Engstrom-Laurent (1997) J. Intern. Med., 242:57-60; Jiang et al. (2007) Ann. Rev. Cell Dev. Biol., 23:435-61). HA can be used itself to modulate disease, for example, in the treatment of joint disease, ophthalmic surgical device or in wound healing.

HA also is involved in disease. HA accumulation, such as by altered hyaluronan metabolism, distribution and function is associated with arthritis, immune and inflammatory disorders, pulmonary and vascular diseases and cancer (Morohashi et al. (2006) Biochem. Biophys. Res. Comm., 345: 1454-1459). Such diseases can be treated by inhibiting HA synthesis or degrading HA (see e.g. Morohashi 2006; U.S. published application No. 20100003238 and International published PCT Appl. No WO 2009/128917). For example, anti-hyaluronan agents, such as hyaluronan degrading enzymes, can be used to treat hyaluronan associated diseases or conditions, including tumors and cancers or inflammatory diseases or conditions. As disclosed herein, such treatments that reduce hyaluronan levels on cells and tissues can be associated with adverse side effects, such as musculoskeletal side effects. As provided herein, these adverse effects can be alleviated or ameliorated by pre-treatment or co-treatment with corticosteroids.

Hence, corticosteroids can be used in methods to reduce adverse side effects, such as musculoskeletal side effects, of any agent that inhibits, degrades or reduces HA accumulation or elevation in disease states. Such agents are known to one of skill in the art or can be identified. For example, effects of agents, including effects of dose and route of administration, on HA synthesis or degradation can be assessed in various assays known to one of skill in the art, including but not limited to any described herein or known in the art, for example, in vitro assays that measure hyaluronan degradation (see e.g. Frost and Stern (1997) Anal. Biochem. 251:263-269), staining tissue or other samples for HA such as by using an HA-binding protein or other anti-HA reagent (see e.g. Nishida et al. (1999) J. Biol. Chem., 274:21893-21899), particle exclusion assay (Nishida et al. 1999; Morohashi et al. (2006) Biochem Biophys. Res. Comm., 345:1454-1459); measuring or assessing HAS mRNA expression for an has gene (Nishida et al. 1999). Exemplary of such anti-hyaluronan agents are agents that inhibit hyaluronan synthesis or degrade hyaluronan.

1. Agents that Inhibit Hyaluronan Synthesis

HA can be synthesized by three enzymes that are the products of three related mammalian genes identified as HA synthases, designated has-1, has-2 and has-3. Different cell types express different HAS enzymes and expression of HAS mRNAs is correlated with HA biosynthesis. It is known that silencing HAS genes in tumor cells inhibits tumor growth and metastasis. An anti-hyaluronan agent includes any agent that inhibits, reduces or downregulates the expression or level of an HA synthase. Such agents are known to one of skill in the art or can be identified.

For example, downregulation of a HAS can be accomplished by providing oligonucleotides that specifically hybridize or otherwise interact with one or more nucleic acid molecules encoding an HAS. For example, anti-hyaluronan agents that inhibit hyaluronan synthesis include antisense or sense molecules against an has gene. Such antisense or sense inhibition is typically based upon hydrogen bonding-based hybridization of oligonucleotide strands or segments such that at least one strand or segment is cleaved, degraded or otherwise rendered inoperable. In other examples, post-transcriptional gene silencing (PTGS), RNAi, ribozymes and DNAzymes can be employed. It is within the level of one skill in the art to generate such constructs based on the sequence of HAS1 (set forth in SEQ ID NO:195), HAS2 (set forth in SEQ ID NO:196) or HAS3 (set forth in SEQ ID NO:197 or 198). It is understood in the art that the sequence of an antisense or sense compound need not be 100% complementary to that of its target nucleic acid to be specifically hybridizable. Moreover, an oligonucleotide may hybridize over one or more segments such that intervening or adjacent segments are not involved in the hybridization event (e.g. a loop structure or hairpin structure). Generally, the antisense or sense compounds have at least 70% sequence complementarity to a target region within the target nucleic acid, for example, 75% to 100% complementarity, such as 75%, 80%, 85%, 90%, 95% or 100%. Exemplary sense or antisense molecules are known in the art (see e.g. Chao et al. (2005) *J. Biol. Chem.,* 280:27513-27522; Simpson et al. (2002) *J. Biol. Chem.,* 277:10050-10057; Simpson et al. (2002) *Am. J Path.,* 161:849; Nishida et al. (1999) *J. Biol. Chem.,* 274:21893-21899; Edward et al. (2010) *British J Dermatology,* 162:1224-1232; Udabage et al. (2005) Cancer Res., 65:6139; and published U.S. Patent application No. US20070286856).

Another exemplary anti-hyaluronan agent that is an HA synthesis inhibitor is 4-Methylumbelliferone (4-MU; 7-hydroxy-4-methylcoumarin) or a derivative thereof. 4-MU acts by reducing the UDP-GlcUA precursor pool that is required for HA synthesis. For example, in mammalian cells, HA is synthesized by HAS using UDP-glucuronic acid (UGA) and UDP-N-acetyl-D-glucosamine precursors. 4-MU interferes with the process by which UGA is generated, thereby depleting the intracellular pool of UGA and resulting in inhibition of HA synthesis. 4-MU is known to have antitumor activity (see e.g. Lokeshwar et al. (2010) Cancer Res., 70:2613-23; Nakazawa et al. (2006) Cancer Chemother. Pharmacol., 57:165-170; Morohashi et al. (2006) Biochem. Biophys. Res. Comm., 345-1454-1459). Oral administration of 4-MU at 600 mg/kg/d) reduces metastases by 64% in the B16 melanoma model (Yoshihara et al. (2005) FEBS Lett., 579:2722-6). The structure of 4-MU is set forth below. Also, derivatives of 4-MU exhibit anti-cancer activity, in particular 6,7-dihydrozy-4-methyl coumarin and 5,7-dihydroxy-4-methyl coumarin (see e.g. Morohashi et al. (2006) Biochem. Biophys. Res. Comm., 345-1454-1459).

4-Methylumbelliferone (4-MU; $C_{10}H_8O_3$)

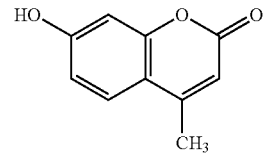

Further exemplary anti-hyaluronan agents are tyrosine kinase inhibitors, such as Leflunomide (Arava), genistein or erbstatin. Leflunomide also is a pyrimidine synthesis inhibitor. Leflunomide is a known drug for the treatment of Rheumatoid arthritis (RA), and also is effective in treating the rejection of allografts as well as xenografts. HA is known to directly or indirectly contribute to HA (see e.g. Stuhlmeier (2005) J Immunol., 174:7376-7382). Tyrosine kinase inhibitors inhibit HAS1 gene expression (Stuhlmeier 2005).

2. Hyaluronan Degrading Enzymes

Anti-hyaluronan agents include hyaluronan degrading enzymes. Hyaluronan is an essential component of the extracellular matrix and a major constituent of the interstitial barrier. By catalyzing the hydrolysis of hyaluronan, hyaluronan degrading enzymes lower the viscosity of hyaluronan, thereby increasing tissue permeability and increasing the absorption rate of fluids administered parenterally. As such, hyaluronan degrading enzymes, such as hyaluronidases, have been used, for example, as spreading or dispersing agents in conjunction with other agents, drugs and proteins to enhance their dispersion and delivery.

Hyaluronan degrading enzymes act to degrade hyaluronan by cleaving hyaluronan polymers, which are composed of repeating disaccharides units, D-glucuronic acid (GlcA) and N-acetyl-D-glucosamine (GlcNAc), linked together via alternating β-1→4 and β-1→3 glycosidic bonds. Hyaluronan chains can reach about 25,000 disaccharide repeats or more in length and polymers of hyaluronan can range in size from about 5,000 to 20,000,000 Da in vivo. Accordingly, hyaluronan degrading enzymes for the uses and methods provided include any enzyme having the ability to catalyze the cleavage of a hyaluronan disaccharide chain or polymer. In some examples the hyaluronan degrading enzyme cleaves the β-1→4 glycosidic bond in the hyaluronan chain or polymer. In other examples, the hyaluronan degrading enzyme catalyze the cleavage of the β-1→3 glycosidic bond in the hyaluronan chain or polymer.

Hence, hyaluronan degrading enzymes, such as hyaluronidases, are a family of enzymes that degrade hyaluronic acid, which is an essential component of the extracellular matrix and a major constituent of the interstitial barrier. By catalyzing the hydrolysis of hyaluronic acid, a major constituent of the interstitial barrier, hyaluronan degrading enzymes lower the viscosity of hyaluronic acid, thereby increasing tissue permeability. As such, hyaluronan degrading enzymes, such as hyaluronidases, have been used, for example, as a spreading or dispersing agent in conjunction with other agents, drugs and proteins to enhance their dispersion and delivery. Hyaluronan-degrading enzymes also are used as an adjuvant to increase the absorption and dispersion of other injected drugs, for hypodermoclysis (subcutaneous fluid administration), and as an adjunct in subcutaneous urography for improving resorption of radiopaque agents. Hyaluronan-degrading enzymes, for example, hyaluronidase can be used in applications of ophthalmic procedures, for example, peribulbar and sub-Tenon's block in local anesthesia prior to ophthalmic surgery. Hyaluronidase also can be use in other therapeutic and cosmetic uses, for example, by promoting akinesia in cosmetic surgery, such as blepharoplasties and face lifts.

Various forms of hyaluronan degrading enzymes, including hyaluronidases have been prepared and approved for therapeutic use in subjects, including humans. The provided compositions and methods can be used, via these and other therapeutic uses, to treat hyaluronan-associated diseases and conditions. For example, animal-derived hyaluronidase preparations include Vitrase® (ISTA Pharmaceuticals), a purified ovine testicular hyaluronidase, Amphadase® (Amphastar Pharmaceuticals), a bovine testicular hyaluronidase and Hydase™ (Prima Pharm Inc.), a bovine testicular hyaluronidase. It is understood that any animal-derived hyaluronidase preparation can be used in the methods and uses provided herein (see, e.g., U.S. Pat. Nos. 2,488,564, 2,488,565, 2,676,139, 2,795,529, 2,806,815, 2,808,362, 5,747,027 and 5,827,721 and Internation PCT Application No. WO2005/118799). Hylenex® (Halozyme Therapeutics) is a human recombinant hyaluronidase produced by genetically engineered Chinese Hamster Ovary (CHO) cells containing nucleic acid encoding soluble forms of PH20, designated rHuPH20.

Exemplary of hyaluronan degrading enzymes in the compositions and methods provided herein are soluble hyaluronidases. Other exemplary hyaluronan degrading enzymes include, but are not limited to particular chondroitinases and lyases that have the ability to cleave hyaluronan.

As described below, hyaluronan-degrading enzymes exist in membrane-bound or soluble forms that are secreted from cells. For purposes herein, soluble hyaluronan-degrading enzymes are provided for use in the methods, uses, compositions or combinations herein. Thus, where hyaluronan-degrading enzymes include a glycosylphosphatidylinositol (GPI) anchor and/or are otherwise membrane-anchored or insoluble, such hyaluronan-degrading enzymes are provided herein in soluble form by truncation or deletion of the GPI anchor to render the enzyme secreted and soluble. Thus, hyaluronan-degrading enzymes include truncated variants, e.g. truncated to remove all or a portion of a GPI anchor. Hyaluronan-degrading enzymes provided herein also include allelic or species variants or other variants, of a soluble hyaluronan-degrading enzyme. For example, hyaluronan degrading enzymes can contain one or more variations in its primary sequence, such as amino acid substitutions, additions and/or deletions. A variant of a hyaluronan-degrading enzyme generally exhibits at least or about 60%, 70%, 80%, 90%, 91%, 92%, 93%, 94%, 95%, 96%, 97%, 98%, 99% or more sequence identity compared to the hyaluronan-degrading enzyme not containing the variation. Any variation can be included in the hyaluronan degrading enzyme for the purposes herein provided the enzyme retains hyaluronidase activity, such as at least or about 5%, 10%, 15%, 20%, 25%, 30%, 35%, 40%, 45%, 50%, 55%, 60%, 65%, 70%, 75%, 80%, 85%, 90%, 95% or more of the activity of a hyaluronan degrading enzyme not containing the variation (as measured by in vitro and/or in vivo assays well known in the art and described herein).

Where the methods and uses provided herein describe the use of a soluble hyaluronidase, accordingly any hyaluronan degrading enzyme, generally a soluble hyaluronan degrading enzyme, can be used. It is understand that any hyaluronidase can be used in the methods and uses provided herein (see, e.g., U.S. Pat. No. 7,767,429 and U.S. Publication Nos. US20040268425 and US20100143457).

a. Hyaluronidases

Hyaluronidases are members of a large family of hyaluronan degrading enzymes. There are three general classes of hyaluronidases: mammalian-type hyaluronidases, bacterial hyaluronidases and hyaluronidases from leeches, other parasites and crustaceans. Such enzymes can be used in the compositions, combinations and methods provided herein.

i. Mammalian-Type Hyaluronidases

Mammalian-type hyaluronidases (EC 3.2.1.35) are endo-β-N-acetylhexosaminidases that hydrolyze the β-1→4 glycosidic bond of hyaluronan into various oligosaccharide lengths such as tetrasaccharides and hexasaccharides. These enzymes have both hydrolytic and transglycosidase activities, and can degrade hyaluronan and chondroitin sulfates (CS), generally C4-S and C6-S. Hyaluronidases of this type include, but are not limited to, hyaluronidases from cows (bovine) (SEQ ID NOS:10, 11 and 64 and BH55 (U.S. Pat. Nos. 5,747,027 and 5,827,721), nucleic acid molecules set forth in SEQ ID NOS:190-192), sheep (*Ovis aries*) (SEQ ID NO: 26, 27, 63 and 65, nucleic acid molecules set forth in SEQ ID NOS:66 and 193-194), yellow jacket wasp (SEQ ID NOS:12 and 13), honey bee (SEQ ID NO:14), white-face hornet (SEQ ID NO:15), paper wasp (SEQ ID NO:16), mouse (SEQ ID NOS:17-19, 32), pig (SEQ ID NOS:20-21), rat (SEQ ID NOS:22-24, 31), rabbit (SEQ ID NO:25), orangutan (SEQ ID NO:28), cynomolgus monkey (SEQ ID NO:29), guinea pig (SEQ ID NO:30), chimpanzee (SEQ ID NO:101), rhesus monkey (SEQ ID NO:102), and human hyaluronidases (SEQ. ID NOS:1-2, 36-39). Exemplary of hyaluronidases in the compositions, combinations and methods provided herein are soluble hyaluronidases.

Mammalian hyaluronidases can be further subdivided into those that are neutral active, predominantly found in testes extracts, and acid active, predominantly found in organs such as the liver. Exemplary neutral active hyaluronidases include PH20, including but not limited to, PH20 derived from different species such as ovine (SEQ ID NOS:27, 63 and 65), bovine (SEQ ID NO:11 and 64) and human (SEQ ID NO:1). Human PH20 (also known as SPAM1 or sperm surface protein PH20), is generally attached to the plasma membrane via a glycosylphosphatidyl inositol (GPI) anchor. It is naturally involved in sperm-egg adhesion and aids penetration by sperm of the layer of cumulus cells by digesting hyaluronic acid.

Besides human PH20 (also termed SPAM1), five hyaluronidase-like genes have been identified in the human genome, HYAL1, HYAL2, HYAL3, HYAL4 and HYALP1. HYALP1 is a pseudogene, and HYAL3 (SEQ ID NO:38) has not been shown to possess enzyme activity toward any known substrates. HYAL4 (precursor polypeptide set forth in SEQ ID NO:39) is a chondroitinase and exhibits little activity towards hyaluronan. HYAL1 (precursor polypeptide set forth in SEQ ID NO:36) is the prototypical acid-active enzyme and PH20 (precursor polypeptide set forth in SEQ ID NO:1) is the prototypical neutral-active enzyme. Acid-active hyaluronidases, such as HYAL1 and HYAL2 (precursor polypeptide set forth in SEQ ID NO:37) generally lack catalytic activity at neutral pH (i.e. pH 7). For example, HYAL1 has little catalytic activity in vitro over pH 4.5 (Frost et al. (1997) Anal. Biochem. 251:263-269). HYAL2 is an acid-active enzyme with a very low specific activity in vitro. The hyaluronidase-like enzymes also can be characterized by those which are generally attached to the plasma membrane via a glycosylphosphatidyl inositol (GPI) anchor such as human HYAL2 and human PH20 (Danilkovitch-Miagkova et al. (2003) Proc Natl Acad Sci USA 100(8): 4580-5), and those which are generally soluble such as human HYAL1 (Frost et al. (1997) Biochem Biophys Res Commun. 236(1):10-5).

PH20

PH20, like other mammalian hyaluronidases, is an endo-β-N-acetyl-hexosaminidase that hydrolyzes the β1→4 glycosidic bond of hyaluronic acid into various oligosaccharide lengths such as tetrasaccharides and hexasaccharides. It has both hydrolytic and transglycosidase activities and can degrade hyaluronic acid and chondroitin sulfates, such as C4-S and C6-S. PH20 is naturally involved in sperm-egg adhesion and aids penetration by sperm of the layer of cumulus cells by digesting hyaluronic acid. PH20 is located on the sperm surface, and in the lysosome-derived acrosome, where it is bound to the inner acrosomal membrane. Plasma membrane PH20 has hyaluronidase activity only at neutral pH, while inner acrosomal membrane PH20 has activity at both neutral and acid pH. In addition to being a hyaluronidase, PH20 also appears to be a receptor for HA-induced cell signaling, and a receptor for the zona pellucida surrounding the oocyte.

Exemplary PH20 proteins include, but are not limited to, human (precursor polypeptide set forth in SEQ ID NO:1, mature polypeptide set forth in SEQ ID NO: 2), chimpanzee (SEQ ID NO:101), Rhesus monkey (SEQ ID NO:102) bovine (SEQ ID NOS: 11 and 64), rabbit (SEQ ID NO: 25), ovine PH20 (SEQ ID NOS: 27, 63 and 65), Cynomolgus monkey (SEQ ID NO: 29), guinea pig (SEQ ID NO: 30), rat (SEQ ID NO: 31) and mouse (SEQ ID NO: 32) PH20 polypeptides.

Bovine PH20 is a 553 amino acid precursor polypeptide (SEQ ID NO:11). Alignment of bovine PH20 with the human PH20 shows only weak homology, with multiple gaps existing from amino acid 470 through to the respective carboxy termini due to the absence of a GPI anchor in the bovine polypeptide (see e.g., Frost G I (2007) Expert Opin. Drug. Deliv. 4: 427-440). In fact, clear GPI anchors are not predicted in many other PH20 species besides humans. Thus, PH20 polypeptides produced from ovine and bovine naturally exist as soluble forms. Though bovine PH20 exists very loosely attached to the plasma membrane, it is not anchored via a phospholipase sensitive anchor (Lalancette et al. (2001) Biol Reprod. 65(2):628-36). This unique feature of bovine hyaluronidase has permitted the use of the soluble bovine testes hyaluronidase enzyme as an extract for clinical use (Wydase®, Hyalase®).

The human PH20 mRNA transcript is normally translated to generate a 509 amino acid precursor polypeptide (SEQ ID NO:1) containing a 35 amino acid signal sequence at the N-terminus (amino acid residue positions 1-35) and a 19 amino acid glycosylphosphatidylinositol (GPI) anchor attachment signal sequence at the C-terminus (amino acid residue positions 491-509). The mature PH20 therefore, is a 474 amino acid polypeptide set forth in SEQ ID NO:2. Following transport of the precursor polypeptide to the ER and removal of the signal peptide, the C-terminal GPI-attachment signal peptide is cleaved to facilitate covalent attachment of a GPI anchor to the newly-formed C-terminal amino acid at the amino acid position corresponding to position 490 of the precursor polypeptide set forth in SEQ ID NO:1. Thus, a 474 amino acid GPI-anchored mature polypeptide with an amino acid sequence set forth in SEQ ID NO:2 is produced.

Human PH20 exhibits hyaluronidase activity at neutral and acid pH. In one aspect, human PH20 is the prototypical neutral-active hyaluronidase that is generally locked to the plasma membrane via a GPI anchor. In another aspect, PH20 is expressed on the inner acrosomal membrane where it has hyaluronidase activity at neutral and acid pH. It appears that PH20 contains two catalytic sites at distinct regions of the polypeptide: the Peptide 1 and Peptide 3 regions (Cherr et aL, (2001) Matrix Biology 20:515-525). Evidence indicates that the Peptide 1 region of PH20, which corresponds to amino acid positions 107-137 of the mature polypeptide set forth in SEQ ID NO:2 and positions 142-172 of the precursor polypeptide set forth in SEQ ID NO:1, is required for enzyme activity at neutral pH. Amino acids at positions 111 and 113 (corresponding to the mature PH20 polypeptide set forth in SEQ ID NO:2) within this region appear to be important for activity, as mutagenesis by amino acid replacement results in PH20 polypeptides with 3% hyaluronidase activity or undetectable hyaluronidase activity, respectively, compared to the wild-type PH20 (Arming et aL, (1997) Eur. J. Biochem. 247:810-814).

The Peptide 3 region, which corresponds to amino acid positions 242-262 of the mature polypeptide set forth in SEQ ID NO:2, and positions 277-297 of the precursor polypeptide set forth in SEQ ID NO: 1, appears to be important for enzyme activity at acidic pH. Within this region, amino acids at positions 249 and 252 of the mature PH20 polypeptide appear to be essential for activity, and mutagenesis of either one results in a polypeptide essentially devoid of activity (Arming et al., (1997) Eur. J. Biochem. 247:810-814).

In addition to the catalytic sites, PH20 also contains a hyaluronan-binding site. Experimental evidence indicate that this site is located in the Peptide 2 region, which corresponds to amino acid positions 205-235 of the precursor polypeptide set forth in SEQ ID NO: 1 and positions 170-200 of the mature polypeptide set forth in SEQ ID NO:2. This region is highly conserved among hyaluronidases and is similar to the heparin binding motif. Mutation of the arginine residue at position 176 (corresponding to the mature PH20 polypeptide set forth in SEQ ID NO:2) to a glycine results in a polypeptide with only about 1% of the hyaluronidase activity of the wild type polypeptide (Arming et al., (1997) Eur. J. Biochem. 247:810-814).

There are seven potential N-linked glycosylation sites in human PH20 at N82, N166, N235, N254, N368, N393, N490 of the polypeptide exemplified in SEQ ID NO: 1. Because amino acids 36 to 464 of SEQ ID NO:1 appear to contain the minimally active human PH20 hyaluronidase domain, the N-linked glycosylation site N-490 is not required for proper hyaluronidase activity. There are six disulfide bonds in human PH20. Two disulfide bonds between the cysteine residues C60 and C351 and between C224 and C238 of the polypeptide exemplified in SEQ ID NO: 1 (corresponding to residues C25 and C316, and C189 and C203 of the mature polypeptide set forth in SEQ ID NO:2, respectively). A further four disulfide bonds are formed between between the cysteine residues C376 and C387; between C381 and C435; between C437 and C443; and between C458 and C464 of the polypeptide exemplified in SEQ ID NO: 1 (corresponding to residues C341 and C352; between C346 and C400; between C402 and C408; and between C423 and C429 of the mature polypeptide set forth in SEQ ID NO:2, respectively).

ii. Bacterial Hyaluronidases

Bacterial hyaluronidases (EC 4.2.2.1 or EC 4.2.99.1) degrade hyaluronan and, to various extents, chondroitin sulfates and dermatan sulfates. Hyaluronan lyases isolated from bacteria differ from hyaluronidases (from other sources, e.g., hyaluronoglucosaminidases, EC 3.2.1.35) by their mode of action. They are endo-β-N-acetylhexosaminidases that catalyze an elimination reaction, rather than hydrolysis, of the β1→4-glycosidic linkage between N-acetyl-beta-D-glucosamine and D-glucuronic acid residues in hyaluronan, yielding 3-(4-deoxy-β-D-gluc-4-enuronosyl)-N-acetyl-D-glucosamine tetra- and hexasaccharides, and disaccharide end products. The reaction results in the formation of oligosaccharides with unsaturated hexuronic acid residues at their nonreducing ends.

Exemplary hyaluronidases from bacteria for use in the compositions, combinations and methods provided include, but are not limited to, hyaluronan degrading enzymes in microorganisms, including strains of *Arthrobacter, Bdellovibrio, Clostridium, Micrococcus, Streptococcus, Peptococcus, Propionibacterium, Bacteroides,* and *Streptomyces*. Particular examples of such strains and enzymes include, but are not limited to *Arthrobacter* sp. (strain FB24) (SEQ ID NO:67), *Bdellovibrio bacteriovorus* (SEQ ID NO:68), *Propionibacterium acnes* (SEQ ID NO:69), *Streptococcus agalactiae* ((SEQ ID NO:70); 18RS21 (SEQ ID NO:71); serotype Ia (SEQ ID NO:72); serotype III (SEQ ID NO:73), *Staphylococcus aureus* (strain COL (SEQ ID NO:74); strain MRSA252 (SEQ ID NOS:75 and 76); strain MSSA476 (SEQ ID NO:77); strain NCTC 8325 (SEQ ID NO:78); strain bovine RF122 (SEQ ID NOS:79 and 80); strain USA300 (SEQ ID NO:81), *Streptococcus pneumoniae* ((SEQ ID NO:82); strain ATCC BAA-255/R6 (SEQ ID NO:83); serotype 2, strain D39/NCTC 7466 (SEQ ID NO:84), *Streptococcus pyogenes* (serotype (SEQ ID NO:85); serotype M2, strain MGAS10270 (SEQ ID NO:86); serotype M4, strain MGAS10750 (SEQ ID NO:87); serotype M6 (SEQ ID NO:88); serotype M12, strain MGAS2096 (SEQ ID NOS:89 and 90); serotype M12, strain MGAS9429 (SEQ ID NO:91); serotype M28 (SEQ ID NO:92); *Streptococcus suis* (SEQ ID NOS:93-95); *Vibrio fischeri* (strain ATCC 700601/ES114 (SEQ ID NO:96)), and the *Streptomyces hyaluronolyticus* hyaluronidase enzyme, which is specific for hyaluronic acid and does not cleave chondroitin or chondroitin sulfate (Ohya, T. and Kaneko, Y. (1970) *Biochim. Biophys. Acta* 198:607).

iii. Hyaluronidases from Leeches, Other Parasites and Crustaceans

Hyaluronidases from leeches, other parasites, and crustaceans (EC 3.2.1.36) are endo-β-glucuronidases that generate tetra- and hexasaccharide end-products. These enzymes catalyze hydrolysis of 1→3-linkages between β-D-glucuronate and N-acetyl-D-glucosamine residues in hyaluronate. Exemplary hyaluronidases from leeches include, but are not limited to, hyaluronidase from Hirudinidae (e.g., *Hirudo medicinalis*), Erpobdellidae (e.g., *Nephelopsis obscura* and *Erpobdella punctata*), Glossiphoniidae (e.g., *Desserobdella picta, Helobdella stagnalis, Glossiphonia complanata, Placobdella ornata* and *Theromyzon* sp.) and Haemopidae (*Haemopis marmorata*) (Hovingh et al. (1999) *Comp Biochem Physiol B Biochem Mol Biol.* 124(3):319-26). An exemplary hyaluronidase from bacteria that has the same mechanism of action as the leech hyaluronidase is that from the cyanobacteria, *Synechococcus* sp. (strain RCC307, SEQ ID NO:97).

b. Other Hyaluronan Degrading Enzymes

In addition to the hyaluronidase family, other hyaluronan degrading enzymes can be used in the compositions, combinations and methods provided. For example, enzymes, including particular chondroitinases and lyases, that have the ability to cleave hyaluronan can be employed. Exemplary chondroitinases that can degrade hyaluronan include, but are not limited to, chondroitin ABC lyase (also known as chondroitinase ABC), chondroitin AC lyase (also known as chondroitin sulfate lyase or chondroitin sulfate eliminase) and chondroitin C lyase. Methods for production and purification of such enzymes for use in the compositions, combinations, and methods provided are known in the art (e.g., U.S. Pat. No. 6,054,569; Yamagata, et al. (1968) *J. Biol. Chem.* 243(7):1523-1535; Yang et al. (1985) *J. Biol. Chem.* 160(30):1849-1857).

Chondroitin ABC lyase contains two enzymes, chondroitin-sulfate-ABC endolyase (EC 4.2.2.20) and chondroitin-sulfate-ABC exolyase (EC 4.2.2.21) (Hamai et al. (1997) *J Biol Chem.* 272(14):9123-30), which degrade a variety of glycosaminoglycans of the chondroitin-sulfate- and dermatan-sulfate type. Chondroitin sulfate, chondroitin-sulfate proteoglycan and dermatan sulfate are the preferred substrates for chondroitin-sulfate-ABC endolyase, but the enzyme also can act on hyaluronan at a lower rate. Chondroitin-sulfate-ABC endolyase degrades a variety of glycosaminoglycans of the chondroitin-sulfate- and dermatan-sulfate type, producing a mixture of Δ4-unsaturated oligosaccharides of different sizes that are ultimately degraded to Δ4-unsaturated tetra- and disaccharides. Chondroitin-sulfate-ABC exolyase has the same substrate specificity but removes disaccharide residues from the non-reducing ends of both polymeric chondroitin sulfates and their oligosaccharide fragments produced by chondroitin-sulfate-ABC endolyase (Hamai, A. et al. (1997) *J. Biol. Chem.* 272:9123-9130). Exemplary chondroitin-sulfate-ABC endolyases and chondroitin-sulfate-ABC exolyases include, but are not limited to, those from *Proteus vulgaris* and *Flavobacterium heparinum* (the *Proteus vulgaris* chondroitin-sulfate-ABC endolyase is set forth in SEQ ID NO: 98 (Sato et al. (1994) *Appl. Microbiol. Biotechnol.* 41(1): 39-46).

Chondroitin AC lyase (EC 4.2.2.5) is active on chondroitin sulfates A and C, chondroitin and hyaluronic acid, but is not active on dermatan sulfate (chondroitin sulfate B). Exemplary chondroitinase AC enzymes from the bacteria include, but are not limited to, those from *Flavobacterium heparinum* and *Victivallis vadensis*, set forth in SEQ ID NOS:99 and 100, respectively, and *Arthrobacter aurescens* (Tkalec et al. (2000) *Applied and Environmental Microbiology* 66(1):29-35; Ernst et al. (1995) *Critical Reviews in Biochemistry and Molecular Biology* 30(5):387-444).

Chondroitinase C cleaves chondroitin sulfate C producing tetrasaccharide plus an unsaturated 6-sulfated disaccharide (delta Di-6S). It also cleaves hyaluronic acid producing unsaturated non-sulfated disaccharide (delta Di-OS). Exemplary chondroitinase C enzymes from the bacteria include, but are not limited to, those from *Streptococcus* and *Flavobacterium* (Hibi et al. (1989) *FEMS-Microbiol-Lett.* 48(2):

121-4; Michelacci et al. (1976) *J. Biol. Chem.* 251:1154-8; Tsuda et al. (1999) *Eur. J. Biochem.* 262:127-133)

c. Soluble Hyaluronan Degrading Enzymes

Provided in the compositions, combinations, uses and methods herein are soluble hyaluronan degrading enzymes, including soluble hyaluronidases. Soluble hyaluronan degrading enzymes include any hyaluronan degrading enzymes that are secreted from cells (e.g. CHO cell) upon expression and exist in soluble form. Such enzymes include, but are not limited to, soluble hyaluronidases, including non-human soluble hyaluronidases, including non-human animal soluble hyaluronidases, bacterial soluble hyaluronidases and human hyaluronidases, Hyal1, bovine PH20 and ovine PH20, allelic variants thereof and other variants thereof. For example, included among soluble hyaluronan degrading enzymes are any hyaluronan degrading enzymes that have been modified to be soluble. For example, hyaluronan degrading enzymes that contain a GPI anchor can be made soluble by truncation of and removal of all or a portion of the GPI anchor. In one example, the human hyaluronidase PH20, which is normally membrane anchored via a GPI anchor, can be made soluble by truncation of and removal of all or a portion of the GPI anchor at the C-terminus.

Soluble hyaluronan degrading enzymes also include neutral active and acid active hyaluronidases. Depending on factors, such as, but not limited to, the desired level of activity of the enzyme following administration and/or site of administration, neutral active and acid active hyaluronidases can be selected. In a particular example, the hyaluronan degrading enzyme for use in the compositions, combinations and methods herein is a soluble neutral active hyaluronidase.

Exemplary of a soluble hyaluronidase is PH20 from any species, such as any set forth in any of SEQ ID NOS: 1, 2, 11, 25, 27, 29-32, 63-65 and 101-102, or truncated forms thereof lacking all or a portion of the C-terminal GPI anchor, so long as the hyaluronidase is soluble (secreted upon expression) and retains hyaluronidase activity. Also included among soluble hyaluronidases are allelic variants or other variants of any of SEQ ID NOS:1, 2, 11, 25, 27, 29-32, 63-65 and 101-102, or truncated forms thereof. Allelic variants and other variants are known to one of skill in the art, and include polypeptides having 60%, 70%, 80%, 90%, 91%, 92%, 93%, 94%, 95%, 96%, 97%, 98%, 99% or more sequence identity to any of SEQ ID NOS: 1, 2, 11, 25, 27, 29-32, 63-65 and 101-102, or truncated forms thereof. Amino acid variants include conservative and non-conservative mutations. It is understood that residues that are important or otherwise required for the activity of a hyaluronidase, such as any described above or known to skill in the art, are generally invariant and cannot be changed. These include, for example, active site residues. Thus, for example, amino acid residues 111, 113 and 176 (corresponding to residues in the mature PH20 polypeptide set forth in SEQ ID NO:2) of a human PH20 polypeptide, or soluble form thereof, are generally invariant and are not altered. Other residues that confer glycosylation and formation of disulfide bonds required for proper folding also can be invariant.

In some instances, the soluble hyaluronan degrading enzyme is normally GPI-anchored (such as, for example, human PH20) and is rendered soluble by truncation at the C-terminus. Such truncation can remove all of the GPI anchor attachment signal sequence, or can remove only some of the GPI anchor attachment signal sequence. The resulting polypeptide, however, is soluble. In instances where the soluble hyaluronan degrading enzyme retains a portion of the GPI anchor attachment signal sequence, 1, 2, 3, 4, 5, 6, 7 or more amino acid residues in the GPI-anchor attachment signal sequence can be retained, provided the polypeptide is soluble. Polypeptides containing one or more amino acids of the GPI anchor are termed extended soluble hyaluronan degrading enzymes. One of skill in the art can determine whether a polypeptide is GPI-anchored using methods well known in the art. Such methods include, but are not limited to, using known algorithms to predict the presence and location of the GPI-anchor attachment signal sequence and co-site, and performing solubility analyses before and after digestion with phosphatidylinositol-specific phospholipase C (PI-PLC) or D (PI-PLD).

Extended soluble hyaluronan degrading enzymes can be produced by making C-terminal truncations to any naturally GPI-anchored hyaluronan degrading enzyme such that the resulting polypeptide is soluble and contains one or more amino acid residues from the GPI-anchor attachment signal sequence (see, e.g., U.S. Published Pat. Appl. No. US20100143457). Exemplary extended soluble hyaluronan degrading enzymes that are C-terminally truncated but retain a portion of the GPI anchor attachment signal sequence include, but are not limited to, extended soluble PH20 (esPH20) polypeptides of primate origin, such as, for example, human and chimpanzee esPH20 polypeptides. For example, the esPH20 polypeptides can be made by C-terminal truncation of any of the mature or precursor polypeptides set forth in SEQ ID NOS:1, 2 or 101, or allelic or other variation thereof, including active fragment thereof, wherein the resulting polypeptide is soluble and retains one or more amino acid residues from the GPI-anchor attachment signal sequence. Allelic variants and other variants are known to one of skill in the art, and include polypeptides having 60%, 70%, 80%, 90%, 91%, 92%, 93%, 94%, 95% or more sequence identity to any of SEQ ID NOS: 1 or 2. The esPH20 polypeptides provided herein can be C-terminally truncated by 1, 2, 3, 4, 5, 6, 7, 8, 9, 10 or more amino acids compared to the wild type polypeptide, such as a polypeptide with a sequence set forth in SEQ ID NOS: 1, 2 or 101, provided the resulting esPH20 polypeptide is soluble and retains 1 or more amino acid residues from the GPI-anchor attachment signal sequence.

Typically, for use in the compositions, combinations and methods herein, a soluble human hylauronan degrading enzyme, such as a soluble human PH20, is used. Although hylauronan degrading enzymes, such as PH20, from other animals can be utilized, such preparations are potentially immunogenic, since they are animal proteins. For example, a significant proportion of patients demonstrate prior sensitization secondary to ingested foods, and since these are animal proteins, all patients have a risk of subsequent sensitization. Thus, non-human preparations may not be suitable for chronic use. If non-human preparations are desired, it is contemplated herein that such polypeptides can be prepared to have reduced immunogenicity. Such modifications are within the level of one of skill in the art and can include, for example, removal and/or replacement of one or more antigenic epitopes on the molecule.

Hyaluronan degrading enzymes, including hyaluronidases (e.g., PH20), used in the methods herein can be recombinantly produced or can be purified or partially-purified from natural sources, such as, for example, from testes extracts. Methods for production of recombinant proteins, including recombinant hyaluronan degrading enzymes, are provided elsewhere herein and are well known in the art.

i. Soluble Human PH20

Exemplary of a soluble hyaluronidase is soluble human PH20. Soluble forms of recombinant human PH20 have been produced and can be used in the compositions, combinations and methods described herein. The production of such soluble forms of PH20 is described in U.S. Published Patent Application Nos. US20040268425; US20050260186, US20060104968, US20100143457 and International PCT application No. WO2009111066. For example, soluble PH20 polypeptides, include C-terminally truncated variant polypeptides that include a sequence of amino acids in SEQ ID NO:1, or have at least 91%, 92%, 93%, 94%, 95%, 95%, 97%, 98% sequence identity to a sequence of amino acids included in SEQ ID NO:1, retain hyaluronidase activity and are soluble. Included among these polypeptides are soluble PH20 polypeptides that completely lack all or a portion of the GPI-anchor attachment signal sequence.

Also included are extended soluble PH20 (esPH20) polypeptides that contain at least one amino acid of the GPI anchor. Thus, instead of having a GPI-anchor covalently attached to the C-terminus of the protein in the ER and being anchored to the extracellular leaflet of the plasma membrane, these polypeptides are secreted and are soluble. C-terminally truncated PH20 polypeptides can be C-terminally truncated by 1, 2, 3, 4, 5, 6, 7, 8, 9, 10, 11, 12, 13, 14, 15, 16, 17, 18, 19, 20, 25, 30, 35, 40, 45, 50, 55, 60 or more amino acids compared to the full length wild type polypeptide, such as a full length wild type polypeptide with a sequence set forth in SEQ ID NOS:1 or 2, or allelic or species variants or other variants thereof.

For example, soluble forms include, but are not limited to, C-terminal truncated polypeptides of human PH20 set forth in SEQ ID NO:1 having a C-terminal amino acid residue 467, 468, 469, 470, 471, 472, 473, 474, 475, 476, 477, 478, 479, 480, 481, 482 and 483, 484, 485, 486, 487, 488, 489, 490, 491, 492, 493, 494, 495, 496, 497, 498, 499 or 500 of the sequence of amino acids set forth in SEQ ID NO:1, or polypeptides that exhibit at least 85% identity thereto. Soluble forms of human PH20 generally include those that contain amino acids 36-464 set forth in SEQ ID NO:1. For example, when expressed in mammalian cells, the 35 amino acid N-terminal signal sequence is cleaved during processing, and the mature form of the protein is secreted. Thus, the mature soluble polypeptides contain amino acids 36 to 467, 468, 469, 470, 471, 472, 473, 474, 475, 476, 477, 478, 479, 480, 481, 482 and 483 of SEQ ID NO:1. Table 3 provides non-limiting examples of exemplary C-terminally truncated PH20 polypeptides, including C-terminally truncated soluble PH20 polypeptides. In Table 3 below, the length (in amino acids) of the precursor and mature polypeptides, and the sequence identifier (SEQ ID NO) in which exemplary amino acid sequences of the precursor and mature polypeptides of the C-terminally truncated PH20 proteins are set forth, are provided. The wild-type PH20 polypeptide also is included in Table 3 for comparison. In particular, exemplary of soluble hyaluronidases are soluble human PH20 polypeptides that are 442, 443, 444, 445, 446 or 447 amino acids in length, such as set forth in any of SEQ ID NOS: 4-9, or allelic or species variants or other variants thereof.

TABLE 3

Exemplary C-terminally truncated PH20 polypeptides

| Polypeptide | Precursor (amino acids) | Precursor SEQ ID NO | Mature (amino acids) | Mature SEQ ID NO |
|---|---|---|---|---|
| wildtype | 509 | 1 | 474 | 2 |
| SPAM1-SILF | 500 | 139 | 465 | 183 |
| SPAM-VSIL | 499 | 106 | 464 | 150 |
| SPAM1-IVSI | 498 | 140 | 463 | 184 |
| SPAM1-FIVS | 497 | 107 | 462 | 151 |
| SPAM1-MFIV | 496 | 141 | 461 | 185 |
| SPAM1-TMFI | 495 | 108 | 460 | 152 |
| SPAM1-ATMF | 494 | 142 | 459 | 186 |
| SPAM1-SATM | 493 | 109 | 458 | 153 |
| SPAM1-LSAT | 492 | 143 | 457 | 187 |
| SPAM1-TLSA | 491 | 110 | 456 | 154 |
| SPAM1-PSTL | 489 | 111 | 454 | 155 |
| SPAM1-SPST | 488 | 144 | 453 | 188 |
| SPAM1-STLS | 490 | 112 | 455 | 156 |
| SPAM1-ASPS | 487 | 113 | 452 | 157 |
| SPAM1-NASP | 486 | 145 | 451 | 189 |
| SPAM1-YNAS | 485 | 114 | 450 | 158 |
| SPAM1-FYNA | 484 | 115 | 449 | 159 |
| SPAM1-IFYN | 483 | 46 | 448 | 48 |
| SPAM1-QIFY | 482 | 3 | 447 | 4 |
| SPAM1-PQIF | 481 | 45 | 446 | 5 |
| SPAM1-EPQI | 480 | 44 | 445 | 6 |
| SPAM1-EEPQ | 479 | 43 | 444 | 7 |
| SPAM1-TEEP | 478 | 42 | 443 | 8 |
| SPAM1-ETEE | 477 | 41 | 442 | 9 |
| SPAM1-METE | 476 | 116 | 441 | 160 |
| SPAM1-PMET | 475 | 117 | 440 | 161 |
| SPAM1-PPME | 474 | 118 | 439 | 162 |
| SPAM1-KPPM | 473 | 119 | 438 | 163 |
| SPAM1-LKPP | 472 | 120 | 437 | 164 |
| SPAM1-FLKP | 471 | 121 | 436 | 165 |
| SPAM1-AFLK | 470 | 122 | 435 | 166 |
| SPAM1-DAFL | 469 | 123 | 434 | 167 |
| SPAM1-IDAF | 468 | 124 | 433 | 168 |
| SPAM1-CIDA | 467 | 40 | 432 | 47 |
| SPAM1-VCID | 466 | 125 | 431 | 169 |
| SPAM1-GVCI | 465 | 126 | 430 | 170 |

Generally soluble forms of PH20 are produced using protein expression systems that facilitate correct N-glycosylation to ensure the polypeptide retains activity, since glycosylation is important for the catalytic activity and stability of hyaluronidases. Such cells include, for example Chinese Hamster Ovary (CHO) cells (e.g. DG44 CHO cells).

ii. rHuPH20

Recombinant soluble forms of human PH20 have been generated and can be used in the compositions, combinations and methods provided herein. The generation of such soluble forms of recombinant human PH20 are described, for example, in U.S. Published Patent Application Nos. US20040268425; US 20050260186; US20060104968; US20100143457; and International PCT Appl. No. WO2009111066. Exemplary of such polypeptides are those generated by expression of a nucleic acid molecule encoding amino acids 1-482 (set forth in SEQ ID NO:3). Such an exemplary nucleic acid molecule is set forth in SEQ ID NO:49. Post translational processing removes the 35 amino acid signal sequence, leaving a 447 amino acid soluble recombinant human PH20 (SEQ ID NO:4). As produced in the culture medium there is heterogeneity at the C-terminus such that the product, designated rHuPH20, includes a mixture of species that can include any one or more of SEQ ID NOS. 4-9 in various abundance. Typically, rHuPH20 is produced in cells that facilitate correct N-glycosylation to retain activity, such as CHO cells (e.g. DG44 CHO cells).

d. Glycosylation of Hyaluronan Degrading Enzymes

Glycosylation, including N- and O-linked glycosylation, of some hyaluronan degrading enzymes, including hyaluronidases, can be important for their catalytic activity and stability. While altering the type of glycan modifying a glycoprotein can have dramatic affects on a protein's antigenicity, structural folding, solubility, and stability, most enzymes are not thought to require glycosylation for optimal enzyme activity. For some hyaluronidases, removal of N-linked glycosylation can result in near complete inactivation of the hyaluronidase activity. Thus, for such hyaluronidases, the presence of N-linked glycans is critical for generating an active enzyme.

N-linked oligosaccharides fall into several major types (oligomannose, complex, hybrid, sulfated), all of which have (Man) 3-GlcNAc-GlcNAc-cores attached via the amide nitrogen of Asn residues that fall within -Asn-Xaa-Thr/Ser-sequences (where Xaa is not Pro). Glycosylation at an -Asn-Xaa-Cys-site has been reported for coagulation protein C. In some instances, a hyaluronan degrading enzyme, such as a hyaluronidase, can contain both N-glycosidic and O-glycosidic linkages. For example, PH20 has O-linked oligosaccharides as well as N-linked oligosaccharides. There are seven potential N-linked glycosylation sites at N82, N166, N235, N254, N368, N393, N490 of human PH20 exemplified in SEQ ID NO: 1. Amino acid residues N82, N166 and N254 are occupied by complex type glycans whereas amino acid residues N368 and N393 are occupied by high mannose type glycans. Amino acid residue N235 is occupied by approximately 80% high mannose type glycans and 20% complex type glycans. As noted above, N-linked glycosylation at N490 is not required for hyaluronidase activity.

In some examples, the hyaluronan degrading enzymes for use in the compositions, combinations and/or methods provided are glycosylated at one or all of the glycosylation sites. For example, for human PH20, or a soluble form thereof, 2, 3, 4, 5, or 6 of the N-glycosylation sites corresponding to amino acids N82, N166, N235, N254, N368, and N393 of SEQ ID NO: 1 are glycosylated. In some examples the hyaluronan degrading enzymes are glycosylated at one or more native glycosylation sites. In other examples, the hyaluronan degrading enzymes are modified at one or more non-native glycosylation sites to confer glycosylation of the polypeptide at one or more additional site. In such examples, attachment of additional sugar moieties can enhance the pharmacokinetic properties of the molecule, such as improved half-life and/or improved activity.

In other examples, the hyaluronan degrading enzymes for use in the compositions, combinations and/or methods provided herein are partially deglycosylated (or N-partially glycosylated polypeptides). For example, partially deglycosylated soluble PH20 polypeptides that retain all or a portion of the hyaluronidase activity of a fully glycosylated hyaluronidase can be used in the compositions, combinations and/or methods provided herein. Exemplary partially deglycosylated hyalurodinases include soluble forms of a partially deglycosylated PH20 polypeptides from any species, such as any set forth in any of SEQ ID NOS: 1, 2, 11, 25, 27, 29-32, 63, 65, and 101-102, or allelic variants, truncated variants, or other variants thereof. Such variants are known to one of skill in the art, and include polypeptides having 60%, 70%, 80%, 90%, 91%, 92%, 93%, 94%, 95% or more sequence identity to any of SEQ ID NOS: 1, 2, 11, 25, 27, 29-32, 63, 65, and 101-102, or truncated forms thereof. The partially deglycosylated hyaluronidases provided herein also include hybrid, fusion and chimeric partially deglycosylated hyaluronidases, and partially deglycosylated hyaluronidase conjugates.

Glycosidases, or glycoside hydrolases, are enzymes that catalyze the hydrolysis of the glycosidic linkage to generate two smaller sugars. The major types of N-glycans in vertebrates include high mannose glycans, hybrid glycans and complex glycans. There are several glycosidases that result in only partial protein deglycosylation, including: EndoF1, which cleaves high mannose and hybrid type glycans; EndoF2, which cleaves biantennary complex type glycans; EndoF3, which cleaves biantennary and more branched complex glycans; and EndoH, which cleaves high mannose and hybrid type glycans. Treatment of a hyaluronan degrading enzyme, such as a soluble hyaluronidase, such as a soluble PH20, with one or all of these glycosidases can result in only partial deglycosylation and, therefore, retention of hyaluronidase activity.

Partially deglycosylated hyaluronan degrading enzymes, such as partially deglycosylated soluble hyaluronidases, can be produced by digestion with one or more glycosidases, generally a glycosidase that does not remove all N-glycans but only partially deglycosylates the protein. For example, treatment of PH20 (e.g. a recombinant PH20 designated rHuPH20) with one or all of the above glycosidases (e.g. EndoF1, EndoF2 and/or EndoF3) results in partial deglycosylation. These partially deglycosylated PH20 polypeptides can exhibit hyaluronidase enzymatic activity that is comparable to the fully glycosylated polypeptides. In contrast, treatment of PH20 with PNGaseF, a glycosidase that cleaves all N-glycans, results in complete removal of all N-glycans and thereby renders PH20 enzymatically inactive. Thus, although all N-linked glycosylation sites (such as, for example, those at amino acids N82, N166, N235, N254, N368, and N393 of human PH20, exemplified in SEQ ID NO: 1) can be glycosylated, treatment with one or more glycosidases can render the extent of glycosylation reduced compared to a hyaluronidase that is not digested with one or more glycosidases.

The partially deglycosylated hyaluronan degrading enzymes, including partially deglycosylated soluble PH20 polypeptides, can have 10%, 20%, 30%, 40%, 50%, 60%, 70% or 80% of the level of glycosylation of a fully glycosylated polypeptide. In one example, 1, 2, 3, 4, 5 or 6 of the N-glycosylation sites corresponding to amino acids N82, N166, N235, N254, N368, and N393 of SEQ ID NO:1 are partially deglycosylated, such that they no longer contain high mannose or complex type glycans, but rather contain at least an N-acetylglucosamine moiety. In some examples, 1, 2 or 3 of the N-glycosylation sites corresponding to amino acids N82, N166 and N254 of SEQ ID NO:1 are deglycosylated, that is, they do not contain a sugar moiety. In other examples, 3, 4, 5, or 6 of the N-glycosylation sites corresponding to amino acids N82, N166, N235, N254, N368, and N393 of SEQ ID NO:1 are glycosylated. Glycosylated amino acid residues minimally contain an N-acetylglucosamine moiety. Typically, the partially deglyclosylated hyaluronan degrading enzymes, including partially deglycosylated soluble PH20 polypeptides, exhibit hyaluronidase activity that is 10%, 20%, 30%, 40%, 50%, 60%, 70%, 80%, 90%, 100%, 110%, 120%, 130%, 140%, 150%, 200%, 300%, 400%, 500%, 1000% or more of the hyaluronidase activity exhibited by the fully glycosylated polypeptide.

e. Modified (Polymer-Conjugated) Hyaluronan Degrading Enzymes

In one example, the provided compositions and combinations contain hyaluronan degrading enzymes, in particular soluble hyaluronidases, that have been modified by conjugation to one or more polymeric molecule (polymer), typically to increase the half-life of the hyaluronan degrading enzyme, for example, to promote prolonged/sustained treatment effects in a subject.

Covalent or other stable attachment (conjugation) of polymeric molecules, such as polyethylene glycol (PEGylation moiety (PEG)), to the hyaluronan degrading enzymes, such as hyaluronidases, impart beneficial properties to the resulting hyaluronan degrading enzyme-polymer composition. Such properties include improved biocompatibility, extension of protein (and enzymatic activity) half-life in the blood, cells and/or in other tissues within a subject, effective shielding of the protein from proteases and hydrolysis, improved biodistribution, enhanced pharmacokinetics and/or pharmacodynamics, and increased water solubility.

Exemplary polymers that can be conjugated to the hyaluronan degrading enzyme, such as the hyaluronidase, include natural and synthetic homopolymers, such as polyols (i.e. poly-OH), polyamines (i.e. poly-$NH_2$) and polycarboxyl acids (i.e. poly-COOH), and further heteropolymers i.e. polymers comprising one or more different coupling groups e.g. a hydroxyl group and amine groups. Examples of suitable polymeric molecules include polymeric molecules selected from among polyalkylene oxides (PAO), such as polyalkylene glycols (PAG), including polyethylene glycols (PEG), methoxypolyethylene glycols (mPEG) and polypropylene glycols, PEG-glycidyl ethers (Epox-PEG), PEG-oxycarbonylimidazole (CDI-PEG) branched polyethylene glycols (PEGs), polyvinyl alcohol (PVA), polycarboxylates, polyvinylpyrrolidone, poly-D,L-amino acids, polyethylene-co-maleic acid anhydride, polystyrene-co-maleic acid anhydride, dextrans including carboxymethyl-dextrans, heparin, homologous albumin, celluloses, including methylcellulose, carboxymethylcellulose, ethylcellulose, hydroxyethylcellulose carboxyethylcellulose and hydroxypropylcellulose, hydrolysates of chitosan, starches such as hydroxyethyl-starches and hydroxypropyl-starches, glycogen, agaroses and derivatives thereof, guar gum, pullulan, inulin, xanthan gum, carrageenan, pectin, alginic acid hydrolysates and bio-polymers.

Typically, the polymers are polyalkylene oxides (PAO), such as polyethylene oxides, such as PEG, typically mPEG, which, in comparison to polysaccharides such as dextran and pullulan, have few reactive groups capable of cross-linking. Typically, the polymers are non-toxic polymeric molecules such as (m)polyethylene glycol (mPEG) which can be covalently conjugated to the hyaluronan degrading enzyme, such as the hyaluronidase (e.g. to attachment groups on the protein's surface) using a relatively simple chemistry.

PEGylation of therapeutics has been reported to increase resistance to proteolysis, increase plasma half-life, and decrease antigenicity and immunogenicity. Examples of PEGylation methodologies are known in the art (see for example, Lu and Felix, *Int. J. Peptide Protein Res.,* 43:127-138, 1994; Lu and Felix, *Peptide Res.,* 6.142-6, 1993; Felix et al., *Int. J Peptide Res.,* 46:253-64, 1995; Benhar et al., *J. Biol. Chem.,* 269: 13398-404, 1994; Brumeanu et al., *J ImmunoL,* 154:3088-95, 1995; see also, Caliceti et al. (2003) *Adv. Drug Deliv. Rev.* 55(10):1261-77 and Molineux (2003) *Pharmacotherapy* 23 (8 Pt 2):3S-8S). PEGylation also can be used in the delivery of nucleic acid molecules in vivo. For example, PEGylation of adenovirus can increase stability and gene transfer (see, e.g., Cheng et al. (2003) *Pharm. Res.* 20(9):1444-51).

Suitable polymeric molecules for attachment to the hyaluronan degrading enzymes, including hyaluronidases, include, but are not limited to, polyethylene glycol (PEG) and PEG derivatives such as methoxy-polyethylene glycols (mPEG), PEG-glycidyl ethers (Epox-PEG), PEG-oxycarbonylimidazole (CDI-PEG), branched PEGs, and polyethylene oxide (PEO) (see e.g. Roberts et al., *Advanced Drug Delivery Review* (2002) 54: 459-476; Harris and Zalipsky, S (eds.) "Poly(ethylene glycol), Chemistry and Biological Applications" ACS Symposium Series 680, 1997; Mehvar et al., *J. Pharm. Pharmaceut. Sci.,* 3(1):125-136, 2000; Harris, (2003) *Nature Reviews Drug Discovery* 2:214-221; and Tsubery, (2004) *J Biol. Chem* 279(37):38118-24). The polymeric molecule can be of a molecular weight typically ranging from about 3 kDa to about 60 kDa. In some embodiments the polymeric molecule that is conjugated to a protein, such as rHuPH20, has a molecular weight of 5, 10, 15, 20, 25, 30, 35, 40, 45, 50, 55, 60 or more than 60 kDa.

PEGylated Soluble Hyaluronan Degrading Enzymes

The hyaluronan degrading enzyme used in the methods, compositions and combinations herein can be a PEGylated hyaluronan degrading enzyme, such as a PEGylated soluble hyaluronan degrading enzyme. In one example, it is a PEGylated soluble hyaluronidase, e.g. PEGylated rHuPH20. Various methods of modifying polypeptides by covalently attaching (conjugating) a PEG or PEG derivative (i.e. "PEGylation") are known in the art (see e.g., U.S. 2006/0104968; U.S. Pat. No. 5,672,662; U.S. Pat. No. 6,737,505; and U.S. 2004/0235734). Techniques for PEGylation include, but are not limited to, specialized linkers and coupling chemistries (see e.g., Roberts, *Adv. Drug Deliv. Rev.* 54:459-476, 2002), attachment of multiple PEG moieties to a single conjugation site (such as via use of branched PEGs; see e.g., Guiotto et al., *Bioorg. Med. Chem. Lett.* 12:177-180, 2002), site-specific PEGylation and/or mono-PEGylation (see e.g., Chapman et al., *Nature Biotech.* 17:780-783, 1999), and site-directed enzymatic PEGylation (see e.g., Sato, *Adv. Drug Deliv. Rev.,* 54:487-504, 2002). Methods and techniques described in the art can produce proteins having 1, 2, 3, 4, 5, 6, 7, 8, 9, 10 or more than 10 PEG or PEG derivatives attached to a single protein molecule (see e.g., U.S. 2006/0104968).

Numerous reagents for PEGylation have been described in the art. Such reagents include, but are not limited to, N-hydroxysuccinimidyl (NHS) activated PEG, succinimidyl mPEG, mPEG$_2$-N-hydroxysuccinimide, mPEG succinimidyl alpha-methylbutanoate, mPEG succinimidyl propionate, mPEG succinimidyl butanoate, mPEG carboxymethyl 3-hydroxybutanoic acid succinimidyl ester, homobifunctional PEG-succinimidyl propionate, homobifunctional PEG propionaldehyde, homobifunctional PEG butyraldehyde, PEG maleimide, PEG hydrazide, p-nitrophenyl-carbonate PEG, mPEG-benzotriazole carbonate, propionaldehyde PEG, mPEG butryaldehyde, branched mPEG$_2$ butyraldehyde, mPEG acetyl, mPEG piperidone, mPEG methylketone, mPEG "linkerless" maleimide, mPEG vinyl sulfone, mPEG thiol, mPEG orthopyridylthioester, mPEG orthopyridyl disulfide, Fmoc-PEG-NHS, Boc-PEG-NHS, vinylsulfone PEG-NHS, acrylate PEG-NHS, fluorescein PEG-NHS, and biotin PEG-NHS (see e.g., Monfardini et al., *Bioconjugate Chem.* 6:62-69, 1995; Veronese et al., *J. Bioactive Compatible Polymers* 12:197-207, 1997; U.S. Pat. No. 5,672,662; U.S. Pat. No. 5,932,462; U.S. Pat. No. 6,495,659; U.S. Pat. No. 6,737,505; U.S. Pat. No. 4,002,531; U.S. Pat. No. 4,179,337; U.S. Pat. No. 5,122,614; U.S. 5,324, 844; U.S. Pat. No. 5,446,090; U.S. Pat. No. 5,612, 460; U.S. Pat. No. 5,643,575; U.S. Pat. No. 5,766,581; U.S. Pat. No. 5,795,569; U.S. Pat. No. 5,808,096; U.S. Pat. No. 5,900,461; U.S. Pat. No. 5,919,455; U.S. Pat. No. 5,985,263;

U.S. Pat. No. 5,990,237; U.S. Pat. No. 6,113,906; U.S. Pat. No. 6,214,966; U.S. Pat. No. 6,258,351; U.S. Pat. No. 6,340,742; U.S. Pat. No. 6,413,507; U.S. Pat. No. 6,420,339; U.S. Pat. No. 6,437,025; U.S. Pat. No. 6,448,369; U.S. Pat. No. 6,461,802; U.S. Pat. No. 6,828,401; U.S. Pat. No. 6,858,736; U.S. 2001/0021763; U.S. 2001/0044526; U.S. 2001/0046481; U.S. 2002/0052430; U.S. 2002/0072573; U.S. 2002/0156047; U.S. 2003/0114647; U.S. 2003/0143596; U.S. 2003/0158333; U.S. 2003/0220447; U.S. 2004/0013637; US 2004/0235734; WO0500360; U.S. 2005/0114037; U.S. 2005/0171328; U.S. 2005/0209416; EP 1064951; EP 0822199; WO 01076640; WO 0002017; WO 0249673; WO 9428024; and WO 0187925).

D. Methods of Producing Nucleic Acids and Encoded Polypeptides of Hyaluronan Degrading Enzymes Polypeptides of a hyaluronan degrading enzyme, such as a soluble hyaluronidase, set forth herein, can be obtained by methods well known in the art for protein purification and recombinant protein expression. Any method known to those of skill in the art for identification of nucleic acids that encode desired genes can be used. Any method available in the art can be used to obtain a full length (i.e., encompassing the entire coding region) cDNA or genomic DNA clone encoding a hyaluronidase, such as from a cell or tissue source. Modified or variant soluble hyaluronidases, can be engineered from a wildtype polypeptide, such as by site-directed mutagenesis.

Polypeptides can be cloned or isolated using any available methods known in the art for cloning and isolating nucleic acid molecules. Such methods include PCR amplification of nucleic acids and screening of libraries, including nucleic acid hybridization screening, antibody-based screening and activity-based screening.

Methods for amplification of nucleic acids can be used to isolate nucleic acid molecules encoding a desired polypeptide, including for example, polymerase chain reaction (PCR) methods. A nucleic acid containing material can be used as a starting material from which a desired polypeptide-encoding nucleic acid molecule can be isolated. For example, DNA and mRNA preparations, cell extracts, tissue extracts, fluid samples (e.g. blood, serum, saliva), samples from healthy and/or diseased subjects can be used in amplification methods. Nucleic acid libraries also can be used as a source of starting material. Primers can be designed to amplify a desired polypeptide. For example, primers can be designed based on expressed sequences from which a desired polypeptide is generated. Primers can be designed based on back-translation of a polypeptide amino acid sequence. Nucleic acid molecules generated by amplification can be sequenced and confirmed to encode a desired polypeptide.

Additional nucleotide sequences can be joined to a polypeptide-encoding nucleic acid molecule, including linker sequences containing restriction endonuclease sites for the purpose of cloning the synthetic gene into a vector, for example, a protein expression vector or a vector designed for the amplification of the core protein coding DNA sequences. Furthermore, additional nucleotide sequences specifying functional DNA elements can be operatively linked to a polypeptide-encoding nucleic acid molecule. Examples of such sequences include, but are not limited to, promoter sequences designed to facilitate intracellular protein expression, and secretion sequences, for example heterologous signal sequences, designed to facilitate protein secretion. Such sequences are known to those of skill in the art. Additional nucleotide residues sequences such as sequences of bases specifying protein binding regions also can be linked to enzyme-encoding nucleic acid molecules. Such regions include, but are not limited to, sequences of residues that facilitate or encode proteins that facilitate uptake of an enzyme into specific target cells, or otherwise alter pharmacokinetics of a product of a synthetic gene. For example, enzymes can be linked to PEG moieties.

In addition, tags or other moieties can be added, for example, to aid in detection or affinity purification of the polypeptide. For example, additional nucleotide residues sequences such as sequences of bases specifying an epitope tag or other detectable marker also can be linked to enzyme-encoding nucleic acid molecules. Exemplary of such sequences include nucleic acid sequences encoding a His tag (e.g., 6×His, HHHHHH; SEQ ID NO:54) or Flag Tag (DYKDDDDK; SEQ ID NO:55).

The identified and isolated nucleic acids can then be inserted into an appropriate cloning vector. A large number of vector-host systems known in the art can be used. Possible vectors include, but are not limited to, plasmids or modified viruses, but the vector system must be compatible with the host cell used. Such vectors include, but are not limited to, bacteriophages such as lambda derivatives, or plasmids such as pCMV4, pBR322 or pUC plasmid derivatives or the Bluescript vector (Stratagene, La Jolla, Calif.). Other expression vectors include the HZ24 expression vector exemplified herein. The insertion into a cloning vector can, for example, be accomplished by ligating the DNA fragment into a cloning vector which has complementary cohesive termini. Insertion can be effected using TOPO cloning vectors (Invitrogen, Carlsbad, Calif.). If the complementary restriction sites used to fragment the DNA are not present in the cloning vector, the ends of the DNA molecules can be enzymatically modified. Alternatively, any site desired can be produced by ligating nucleotide sequences (linkers) onto the DNA termini; these ligated linkers can contain specific chemically synthesized oligonucleotides encoding restriction endonuclease recognition sequences. In an alternative method, the cleaved vector and protein gene can be modified by homopolymeric tailing. Recombinant molecules can be introduced into host cells via, for example, transformation, transfection, infection, electroporation and sonoporation, so that many copies of the gene sequence are generated.

In specific embodiments, transformation of host cells with recombinant DNA molecules that incorporate the isolated protein gene, cDNA, or synthesized DNA sequence enables generation of multiple copies of the gene. Thus, the gene can be obtained in large quantities by growing transformants, isolating the recombinant DNA molecules from the transformants and, when necessary, retrieving the inserted gene from the isolated recombinant DNA.

1. Vectors and Cells

For recombinant expression of one or more of the desired proteins, such as any hyaluronan degrading enzyme polypeptide described herein, the nucleic acid containing all or a portion of the nucleotide sequence encoding the protein can be inserted into an appropriate expression vector, i.e., a vector that contains the necessary elements for the transcription and translation of the inserted protein coding sequence. The necessary transcriptional and translational signals also can be supplied by the native promoter for enzyme genes, and/or their flanking regions.

Also provided are vectors that contain a nucleic acid encoding the enzyme. Cells containing the vectors also are provided. The cells include eukaryotic and prokaryotic cells, and the vectors are any suitable for use therein.

Prokaryotic and eukaryotic cells, including endothelial cells, containing the vectors are provided. Such cells include bacterial cells, yeast cells, fungal cells, Archea, plant cells, insect cells and animal cells. The cells are used to produce a protein thereof by growing the above-described cells under conditions whereby the encoded protein is expressed by the cell, and recovering the expressed protein. For purposes herein, for example, the enzyme can be secreted into the medium.

Provided are vectors that contain a sequence of nucleotides that encodes the hyaluronan degrading enzyme polypeptide, in some examples a soluble hyaluronidase polypeptide, coupled to the native or heterologous signal sequence, as well as multiple copies thereof. The vectors can be selected for expression of the enzyme protein in the cell or such that the enzyme protein is expressed as a secreted protein.

A variety of host-vector systems can be used to express the protein coding sequence. These include but are not limited to mammalian cell systems infected with virus (e.g. vaccinia virus, adenovirus and other viruses); insect cell systems infected with virus (e.g. baculovirus); microorganisms such as yeast containing yeast vectors; or bacteria transformed with bacteriophage, DNA, plasmid DNA, or cosmid DNA. The expression elements of vectors vary in their strengths and specificities. Depending on the host-vector system used, any one of a number of suitable transcription and translation elements can be used.

Any methods known to those of skill in the art for the insertion of DNA fragments into a vector can be used to construct expression vectors containing a chimeric gene containing appropriate transcriptional/translational control signals and protein coding sequences. These methods can include in vitro recombinant DNA and synthetic techniques and in vivo recombinants (genetic recombination). Expression of nucleic acid sequences encoding protein, or domains, derivatives, fragments or homologs thereof, can be regulated by a second nucleic acid sequence so that the genes or fragments thereof are expressed in a host transformed with the recombinant DNA molecule(s). For example, expression of the proteins can be controlled by any promoter/enhancer known in the art. In a specific embodiment, the promoter is not native to the genes for a desired protein. Promoters which can be used include but are not limited to the SV40 early promoter (Bernoist and Chambon, *Nature* 290:304-310 (1981)), the promoter contained in the 3' long terminal repeat of Rous sarcoma virus (Yamamoto et al. *Cell* 22:787-797 (1980)), the herpes thymidine kinase promoter (Wagner et al., *Proc. Natl. Acad. Sci. USA* 78:1441-1445 (1981)), the regulatory sequences of the metallothionein gene (Brinster et al., *Nature* 296:39-42 (1982)); prokaryotic expression vectors such as the β-lactamase promoter (Jay et al., (1981) *Proc. Natl. Acad. Sci. USA* 78:5543) or the tac promoter (DeBoer et al., *Proc. Natl. Acad. Sci. USA* 80:21-25 (1983)); see also "Useful Proteins from Recombinant Bacteria": in Scientific American 242:79-94 (1980); plant expression vectors containing the nopaline synthetase promoter (Herrara-Estrella et al., *Nature* 303:209-213 (1984)) or the cauliflower mosaic virus 35S RNA promoter (Gardner et al., *Nucleic Acids Res.* 9:2871 (1981)), and the promoter of the photosynthetic enzyme ribulose bisphosphate carboxylase (Herrera-Estrella et al., *Nature* 310:115-120 (1984)); promoter elements from yeast and other fungi such as the Gal4 promoter, the alcohol dehydrogenase promoter, the phosphoglycerol kinase promoter, the alkaline phosphatase promoter, and the following animal transcriptional control regions that exhibit tissue specificity and have been used in transgenic animals: elastase I gene control region which is active in pancreatic acinar cells (Swift et al., *Cell* 38:639-646 (1984); Ornitz et al., *Cold Spring Harbor Symp. Quant. Biol.* 50:399-409 (1986); MacDonald, *Hepatology* 7:425-515 (1987)); insulin gene control region which is active in pancreatic beta cells (Hanahan et al., *Nature* 315:115-122 (1985)), immunoglobulin gene control region which is active in lymphoid cells (Grosschedl et al., *Cell* 38:647-658 (1984); Adams et al., *Nature* 318:533-538 (1985); Alexander et al., *Mol. Cell Biol.* 7:1436-1444 (1987)), mouse mammary tumor virus control region which is active in testicular, breast, lymphoid and mast cells (Leder et al., *Cell* 45:485-495 (1986)), albumin gene control region which is active in liver (Pinkert et al., *Genes and Devel.* 1:268-276 (1987)), alpha-fetoprotein gene control region which is active in liver (Krumlauf et al., *Mol. Cell. Biol.* 5:1639-1648 (1985); Hammer et al., *Science* 235:53-58 1987)), alpha-1 antitrypsin gene control region which is active in liver (Kelsey et al., *Genes and Devel.* 1:161-171 (1987)), beta globin gene control region which is active in myeloid cells (Magram et al., *Nature* 315:338-340 (1985); Kollias et al., *Cell* 46:89-94 (1986)), myelin basic protein gene control region which is active in oligodendrocyte cells of the brain (Readhead et al., *Cell* 48:703-712 (1987)), myosin light chain-2 gene control region which is active in skeletal muscle (Shani, *Nature* 314:283-286 (1985)), and gonadotrophic releasing hormone gene control region which is active in gonadotrophs of the hypothalamus (Mason et al., *Science* 234:1372-1378 (1986)).

In a specific embodiment, a vector is used that contains a promoter operably linked to nucleic acids encoding a desired protein, or a domain, fragment, derivative or homolog, thereof, one or more origins of replication, and optionally, one or more selectable markers (e.g., an antibiotic resistance gene). Exemplary plasmid vectors for transformation of *E. coli* cells, include, for example, the pQE expression vectors (available from Qiagen, Valencia, Calif.; see also literature published by Qiagen describing the system). pQE vectors have a phage T5 promoter (recognized by *E. coli* RNA polymerase) and a double lac operator repression module to provide tightly regulated, high-level expression of recombinant proteins in *E. coli*, a synthetic ribosomal binding site (RBS II) for efficient translation, a 6×His tag coding sequence, $t_0$ and T1 transcriptional terminators, ColE1 origin of replication, and a beta-lactamase gene for conferring ampicillin resistance. The pQE vectors enable placement of a 6×His tag at either the N- or C-terminus of the recombinant protein. Such plasmids include pQE 32, pQE 30, and pQE 31 which provide multiple cloning sites for all three reading frames and provide for the expression of N-terminally 6×His-tagged proteins. Other exemplary plasmid vectors for transformation of *E. coli* cells, include, for example, the pET expression vectors (see, U.S. Pat. No. 4,952,496; available from Novagen, Madison, Wis.; see, also literature published by Novagen describing the system). Such plasmids include pET 11a, which contains the T7lac promoter, T7 terminator, the inducible *E. coli* lac operator, and the lac repressor gene; pET 12a-c, which contains the T7 promoter, T7 terminator, and the *E. coli* ompT secretion signal; and pET 15b and pET19b (Novagen, Madison, Wis.), which contain a His-Tag™ leader sequence for use in purification with a His column and a thrombin cleavage site that permits cleavage following purification over the column, the T7-lac promoter region and the T7 terminator.

Exemplary of a vector for mammalian cell expression is the HZ24 expression vector. The HZ24 expression vector was derived from the pCI vector backbone (Promega). It contains DNA encoding the Beta-lactamase resistance gene (AmpR), an F1 origin of replication, a Cytomegalovirus immediate-early enhancer/promoter region (CMV), and an SV40 late polyadenylation signal (SV40). The expression vector also has an internal ribosome entry site (IRES) from the ECMV virus (Clontech) and the mouse dihydrofolate reductase (DHFR) gene.

2. Expression

Hyaluronan degrading enzyme polypeptides, including soluble hyaluronidase polypeptides, can be produced by any method known to those of skill in the art including in vivo and in vitro methods. Desired proteins can be expressed in any organism suitable to produce the required amounts and forms of the proteins, such as for example, needed for administration and treatment. Expression hosts include prokaryotic and eukaryotic organisms such as *E. coli*, yeast, plants, insect cells, mammalian cells, including human cell lines and transgenic animals. Expression hosts can differ in their protein production levels as well as the types of post-translational modifications that are present on the expressed proteins. The choice of expression host can be made based on these and other factors, such as regulatory and safety considerations, production costs and the need and methods for purification.

Many expression vectors are available and known to those of skill in the art and can be used for expression of proteins. The choice of expression vector will be influenced by the choice of host expression system. In general, expression vectors can include transcriptional promoter's and optionally enhancers, translational signals, and transcriptional and translational termination signals. Expression vectors that are used for stable transformation typically have a selectable marker which allows selection and maintenance of the transformed cells. In some cases, an origin of replication can be used to amplify the copy number of the vector.

Hyaluronan degrading enzyme polypeptides, such as soluble hyaluronidase polypeptides, also can be utilized or expressed as protein fusions. For example, an enzyme fusion can be generated to add additional functionality to an enzyme. Examples of enzyme fusion proteins include, but are not limited to, fusions of a signal sequence, a tag such as for localization, e.g. a his$_6$ tag or a myc tag, or a tag for purification, for example, a GST fusion, and a sequence for directing protein secretion and/or membrane association.

a. Prokaryotic Cells

Prokaryotes, especially *E. coli*, provide a system for producing large amounts of proteins. Transformation of *E. coli* is a simple and rapid technique well known to those of skill in the art. Expression vectors for *E. coli* can contain inducible promoters, such promoters are useful for inducing high levels of protein expression and for expressing proteins that exhibit some toxicity to the host cells. Examples of inducible promoters include the lac promoter, the trp promoter, the hybrid tac promoter, the T7 and SP6 RNA promoters and the temperature regulated XPL promoter.

Proteins, such as any provided herein, can be expressed in the cytoplasmic environment of *E. coli*. The cytoplasm is a reducing environment and for some molecules, this can result in the formation of insoluble inclusion bodies. Reducing agents such as dithiothreitol and β-mercaptoethanol and denaturants, such as guanidine-HCl and urea can be used to resolubilize the proteins. An alternative approach is the expression of proteins in the periplasmic space of bacteria which provides an oxidizing environment and chaperonin-like and disulfide isomerases and can lead to the production of soluble protein. Typically, a leader sequence is fused to the protein to be expressed which directs the protein to the periplasm. The leader is then removed by signal peptidases inside the periplasm. Examples of periplasmic-targeting leader sequences include the pelB leader from the pectate lyase gene and the leader derived from the alkaline phosphatase gene. In some cases, periplasmic expression allows leakage of the expressed protein into the culture medium. The secretion of proteins allows quick and simple purification from the culture supernatant. Proteins that are not secreted can be obtained from the periplasm by osmotic lysis. Similar to cytoplasmic expression, in some cases proteins can become insoluble and denaturants and reducing agents can be used to facilitate solubilization and refolding. Temperature of induction and growth also can influence expression levels and solubility, typically temperatures between 25° C. and 37° C. are used. Typically, bacteria produce aglycosylated proteins. Thus, if proteins require glycosylation for function, glycosylation can be added in vitro after purification from host cells.

b. Yeast Cells

Yeasts such as *Saccharomyces cerevisae, Schizosaccharomyces pombe, Yarrowia lipolytica, Kluyveromyces lactis* and *Pichia pastoris* are well known yeast expression hosts that can be used for production of proteins, such as any described herein. Yeast can be transformed with episomal replicating vectors or by stable chromosomal integration by homologous recombination. Typically, inducible promoters are used to regulate gene expression. Examples of such promoters include GAL1, GAL7 and GAL5 and metallothionein promoters, such as CUP1, AOX1 or other *Pichia* or other yeast promoter. Expression vectors often include a selectable marker such as LEU2, TRP1, HIS3 and URA3 for selection and maintenance of the transformed DNA. Proteins expressed in yeast are often soluble. Co-expression with chaperonins such as Bip and protein disulfide isomerase can improve expression levels and solubility. Additionally, proteins expressed in yeast can be directed for secretion using secretion signal peptide fusions such as the yeast mating type alpha-factor secretion signal from *Saccharomyces cerevisae* and fusions with yeast cell surface proteins such as the Aga2p mating adhesion receptor or the *Arxula adeninivorans* glucoamylase. A protease cleavage site such as for the Kex-2 protease, can be engineered to remove the fused sequences from the expressed polypeptides as they exit the secretion pathway. Yeast also is capable of glycosylation at Asn-X-Ser/Thr motifs.

c. Insect Cells

Insect cells, particularly using baculovirus expression, are useful for expressing polypeptides such as hyaluronidase polypeptides. Insect cells express high levels of protein and are capable of most of the post-translational modifications used by higher eukaryotes. Baculovirus have a restrictive host range which improves the safety and reduces regulatory concerns of eukaryotic expression. Typical expression vectors use a promoter for high level expression such as the polyhedrin promoter of baculovirus. Commonly used baculovirus systems include the baculoviruses such as *Autographa californica* nuclear polyhedrosis virus (AcNPV), and the *Bombyx mori* nuclear polyhedrosis virus (BmNPV) and an insect cell line such as Sf9 derived from *Spodoptera frugiperda, Pseudaletia unipuncta* (A7S) and *Danaus plexippus* (DpN1). For high-level expression, the nucleotide sequence of the molecule to be expressed is fused immediately downstream of the polyhedrin initiation codon of the virus. Mammalian secretion signals are accurately processed in insect cells and can be used to secrete the expressed protein into the culture medium. In addition, the cell lines *Pseudaletia unipuncta* (A7S) and *Danaus plexippus* (DpN1) produce proteins with glycosylation patterns similar to mammalian cell systems.

An alternative expression system in insect cells is the use of stably transformed cells. Cell lines such as the Schneider 2 (S2) and Kc cells (*Drosophila melanogaster*) and C7 cells (*Aedes albopictus*) can be used for expression. The *Drosophila* metallothionein promoter can be used to induce high levels of expression in the presence of heavy metal induction with cadmium or copper. Expression vectors are typically maintained by the use of selectable markers such as neomycin and hygromycin.

d. Mammalian Cells

Mammalian expression systems can be used to express proteins including hyaluronan degrading enzyme polypeptides, such as soluble hyaluronidase polypeptides. Expression constructs can be transferred to mammalian cells by viral infection such as adenovirus or by direct DNA transfer such as liposomes, calcium phosphate, DEAE-dextran and by physical means such as electroporation and microinjection. Expression vectors for mammalian cells typically include an mRNA cap site, a TATA box, a translational initiation sequence (Kozak consensus sequence) and polyadenylation elements. IRES elements also can be added to permit bicistronic expression with another gene, such as a selectable marker. Such vectors often include transcriptional promoter-enhancers for high-level expression, for example the SV40 promoter-enhancer, the human cytomegalovirus (CMV) promoter and the long terminal repeat of Rous sarcoma virus (RSV). These promoter-enhancers are active in many cell types. Tissue and cell-type promoters and enhancer regions also can be used for expression. Exemplary promoter/enhancer regions include, but are not limited to, those from genes such as elastase I, insulin, immunoglobulin, mouse mammary tumor virus, albumin, alpha fetoprotein, alpha 1 antitrypsin, beta globin, myelin basic protein, myosin light chain 2, and gonadotropic releasing hormone gene control. Selectable markers can be used to select for and maintain cells with the expression construct. Examples of selectable marker genes include, but are not limited to, hygromycin B phosphotransferase, adenosine deaminase, xanthine-guanine phosphoribosyl transferase, aminoglycoside phosphotransferase, dihydrofolate reductase (DHFR) and thymidine kinase. For example, expression can be performed in the presence of methotrexate to select for only those cells expressing the DHFR gene. Fusion with cell surface signaling molecules such as TCR-ζ and Fc$_\epsilon$RI-γ can direct expression of the proteins in an active state on the cell surface.

Many cell lines are available for mammalian expression including mouse, rat human, monkey, chicken and hamster cells. Exemplary cell lines include but are not limited to CHO, Balb/3T3, HeLa, MT2, mouse NS0 (nonsecreting) and other myeloma cell lines, hybridoma and heterohybridoma cell lines, lymphocytes, fibroblasts, Sp2/0, COS, NIH3T3, HEK293, 293S, 2B8, and HKB cells. Cell lines also are available adapted to serum-free media which facilitates purification of secreted proteins from the cell culture media. Examples include CHO-S cells (Invitrogen, Carlsbad, Calif., cat #11619-012) and the serum free EBNA-1 cell line (Pham et al., (2003) *Biotechnol. Bioeng.* 84:332-342). Cell lines also are available that are adapted to grow in special media optimized for maximal expression. For example, DG44 CHO cells are adapted to grow in suspension culture in a chemically defined, animal product-free medium.

e. Plants

Transgenic plant cells and plants can be used to express proteins such as any described herein. Expression constructs are typically transferred to plants using direct DNA transfer such as microprojectile bombardment and PEG-mediated transfer into protoplasts, and with *agrobacterium*-mediated transformation. Expression vectors can include promoter and enhancer sequences, transcriptional termination elements and translational control elements. Expression vectors and transformation techniques are usually divided between dicot hosts, such as *Arabidopsis* and tobacco, and monocot hosts, such as corn and rice. Examples of plant promoters used for expression include the cauliflower mosaic virus promoter, the nopaline synthetase promoter, the ribose bisphosphate carboxylase promoter and the ubiquitin and UBQ3 promoters. Selectable markers such as hygromycin, phosphomannose isomerase and neomycin phosphotransferase are often used to facilitate selection and maintenance of transformed cells. Transformed plant cells can be maintained in culture as cells, aggregates (callus tissue) or regenerated into whole plants. Transgenic plant cells also can include algae engineered to produce hyaluronidase polypeptides. Because plants have different glycosylation patterns than mammalian cells, this can influence the choice of protein produced in these hosts.

3. Purification Techniques

Method for purification of polypeptides, including hyaluronan degrading enzyme polypeptides (e.g. soluble hyaluronidase polypeptides) or other proteins, from host cells will depend on the chosen host cells and expression systems. For secreted molecules, proteins are generally purified from the culture media after removing the cells. For intracellular expression, cells can be lysed and the proteins purified from the extract. When transgenic organisms such as transgenic plants and animals are used for expression, tissues or organs can be used as starting material to make a lysed cell extract. Additionally, transgenic animal production can include the production of polypeptides in milk or eggs, which can be collected, and if necessary, the proteins can be extracted and further purified using standard methods in the art.

Proteins, such as soluble hyaluronidase polypeptides, can be purified using standard protein purification techniques known in the art including but not limited to, SDS-PAGE, size fraction and size exclusion chromatography, ammonium sulfate precipitation and ionic exchange chromatography, such as anion exchange chromatography. Affinity purification techniques also can be utilized to improve the efficiency and purity of the preparations. For example, antibodies, receptors and other molecules that bind hyaluronidase enzymes can be used in affinity purification. Expression constructs also can be engineered to add an affinity tag to a protein such as a myc epitope, GST fusion or His$_6$ and affinity purified with myc antibody, glutathione resin and Ni-resin, respectively. Purity can be assessed by any method known in the art including gel electrophoresis and staining and spectrophotometric techniques. Purified rHuPH20 compositions, as provided herein, typically have a specific activity of at least 70,000 to 100,000 Units/mg, for example, about 120,000 Units/mg. The specific activity can vary upon modification, such as with a polymer.

4. PEGylation of Hyaluronan Degrading Enzyme Polypeptides

Polyethylene glycol (PEG) has been widely used in biomaterials, biotechnology and medicine primarily because PEG is a biocompatible, nontoxic, water-soluble polymer that is typically nonimmunogenic (Zhao and Harris, *ACS Symposium Series* 680: 458-72, 1997). In the area of drug delivery, PEG derivatives have been widely used in covalent attachment (i.e., "PEGylation") to proteins to reduce immunogenicity, proteolysis and kidney clearance and to enhance solubility (Zalipsky, Adv. Drug Del. Rev. 16:157-82, 1995). Similarly, PEG has been attached to low molecular weight, relatively hydrophobic drugs to enhance solubility, reduce toxicity and alter biodistribution. Typically, PEGylated drugs are injected as solutions.

A closely related application is synthesis of crosslinked degradable PEG networks or formulations for use in drug delivery since much of the same chemistry used in design of degradable, soluble drug carriers can also be used in design of degradable gels (Sawhney et al., *Macromolecules* 26: 581-87, 1993). It also is known that intermacromolecular complexes can be formed by mixing solutions of two complementary polymers. Such complexes are generally stabilized by electrostatic interactions (polyanion-polycation) and/or hydrogen bonds (polyacid-polybase) between the polymers involved, and/or by hydrophobic interactions between the polymers in an aqueous surrounding (Krupers et al., *Eur. Polym J.* 32:785-790, 1996). For example, mixing solutions of polyacrylic acid (PAAc) and polyethylene oxide (PEO) under the proper conditions results in the formation of complexes based mostly on hydrogen bonding. Dissociation of these complexes at physiologic conditions has been used for delivery of free drugs (i.e., non-PEGylated). In addition, complexes of complementary polymers have been formed from both homopolymers and copolymers.

Numerous reagents for PEGylation have been described in the art. Such reagents include, but are not limited to, N-hydroxysuccinimidyl (NHS) activated PEG, succinimidyl mPEG, mPEG$_2$-N-hydroxysuccinimide, mPEG succinimidyl alpha-methylbutanoate, mPEG succinimidyl propionate, mPEG succinimidyl butanoate, mPEG carboxymethyl 3-hydroxybutanoic acid succinimidyl ester, homobifunctional PEG-succinimidyl propionate, homobifunctional PEG propionaldehyde, homobifunctional PEG butyraldehyde, PEG maleimide, PEG hydrazide, p-nitrophenyl-carbonate PEG, mPEG-benzotriazole carbonate, propionaldehyde PEG, mPEG butryaldehyde, branched mPEG$_2$ butyraldehyde, mPEG acetyl, mPEG piperidone, mPEG methylketone, mPEG "linkerless" maleimide, mPEG vinyl sulfone, mPEG thiol, mPEG orthopyridylthioester, mPEG orthopyridyl disulfide, Fmoc-PEG-NHS, Boc-PEG-NHS, vinylsulfone PEG-NHS, acrylate PEG-NHS, fluorescein PEG-NHS, and biotin PEG-NHS (see e.g., Monfardini et al., *Bioconjugate Chem.* 6:62-69, 1995; Veronese et al., *J. Bioactive Compatible Polymers* 12:197-207, 1997; U.S. Pat. No. 5,672,662; U.S. Pat. No. 5,932,462; U.S. Pat. No. 6,495,659; U.S. Pat. No. 6,737,505; U.S. Pat. No. 4,002,531; U.S. Pat. No. 4,179,337; U.S. Pat. No. 5,122,614; U.S. 5,324, 844; U.S. Pat. No. 5,446,090; U.S. Pat. No. 5,612, 460; U.S. Pat. No. 5,643,575; U.S. Pat. No. 5,766,581; U.S. Pat. No. 5,795,569; U.S. Pat. No. 5,808,096; U.S. Pat. No. 5,900,461; U.S. Pat. No. 5,919,455; U.S. Pat. No. 5,985,263; U.S. Pat. No. 5,990,237; U.S. Pat. No. 6,113,906; U.S. Pat. No. 6,214,966; U.S. Pat. No. 6,258,351; U.S. Pat. No. 6,340,742; U.S. Pat. No. 6,413,507; U.S. Pat. No. 6,420,339; U.S. Pat. No. 6,437,025; U.S. Pat. No. 6,448,369; U.S. Pat. No. 6,461,802; U.S. Pat. No. 6,828,401; U.S. Pat. No. 6,858,736; U.S. 2001/0021763; U.S. 2001/0044526; U.S. 2001/0046481; U.S. 2002/0052430; U.S. 2002/0072573; U.S. 2002/0156047; U.S. 2003/0114647; U.S. 2003/0143596; U.S. 2003/0158333; U.S. 2003/0220447; U.S. 2004/0013637; US 2004/0235734; WO0500360; U.S. 2005/0114037; U.S. 2005/0171328; U.S. 2005/0209416; EP 01064951; EP 0822199; WO 01076640; WO 0002017; WO 0249673; WO 9428024; and WO 0187925).

In one example, the polyethylene glycol has a molecular weight ranging from about 3 kD to about 50 kD, and typically from about 5 kD to about 30 kD. Covalent attachment of the PEG to the drug (known as "PEGylation") can be accomplished by known chemical synthesis techniques. For example, the PEGylation of protein can be accomplished by reacting NHS-activated PEG with the protein under suitable reaction conditions.

While numerous reactions have been described for PEGylation, those that are most generally applicable confer directionality, utilize mild reaction conditions, and do not necessitate extensive downstream processing to remove toxic catalysts or bi-products. For instance, monomethoxy PEG (mPEG) has only one reactive terminal hydroxyl, and thus its use limits some of the heterogeneity of the resulting PEG-protein product mixture. Activation of the hydroxyl group at the end of the polymer opposite to the terminal methoxy group is generally necessary to accomplish efficient protein PEGylation, with the aim being to make the derivatised PEG more susceptible to nucleophilic attack. The attacking nucleophile is usually the epsilon-amino group of a lysyl residue, but other amines also can react (e.g. the N-terminal alpha-amine or the ring amines of histidine) if local conditions are favorable. A more directed attachment is possible in proteins containing a single lysine or cysteine. The latter residue can be targeted by PEG-maleimide for thiol-specific modification. Alternatively, PEG hydrazide can be reacted with a periodate oxidized hyaluronan degrading enzyme and reduced in the presence of NaCNBH$_3$. More specifically, PEGylated CMP sugars can be reacted with a hyaluronan degrading enzyme in the presence of appropriate glycosyl-transferases. One technique is the "PEGylation" technique where a number of polymeric molecules are coupled to the polypeptide in question. When using this technique the immune system has difficulties in recognizing the epitopes on the polypeptide's surface responsible for the formation of antibodies, thereby reducing the immune response. For polypeptides introduced directly into the circulatory system of the human body to give a particular physiological effect (i.e. pharmaceuticals) the typical potential immune response is an IgG and/or IgM response, while polypeptides which are inhaled through the respiratory system (i.e. industrial polypeptide) potentially can cause an IgE response (i.e. allergic response). One of the theories explaining the reduced immune response is that the polymeric molecule(s) shield(s) epitope(s) on the surface of the polypeptide responsible for the immune response leading to antibody formation. Another theory or at least a partial factor is that the heavier the conjugate is, the more reduced immune response is obtained.

Typically, to make the PEGylated hyaluronan degrading enzymes provided herein, including the PEGylated hyaluronidases, PEG moieties are conjugated, via covalent attachment, to the polypeptides. Techniques for PEGylation include, but are not limited to, specialized linkers and coupling chemistries (see e.g., Roberts, *Adv. Drug Deliv. Rev.* 54:459-476, 2002), attachment of multiple PEG moieties to a single conjugation site (such as via use of branched PEGs; see e.g., Guiotto et al., *Bioorg. Med. Chem. Lett.*

12:177-180, 2002), site-specific PEGylation and/or monoPEGylation (see e.g., Chapman et al., *Nature Biotech.* 17:780-783, 1999), and site-directed enzymatic PEGylation (see e.g., Sato, *Adv. Drug Deliv. Rev.,* 54:487-504, 2002). Methods and techniques described in the art can produce proteins having 1, 2, 3, 4, 5, 6, 7, 8, 9, 10 or more than 10 PEG or PEG derivatives' attached to a single protein molecule (see e.g., U.S. 2006/0104968).

As an exemplary illustration of the PEGylation of an illustrative method for making PEGylated hyaluronan degrading enzymes, such as PEGylated hyaluronidases, PEG aldehydes, succinimides and carbonates have each been applied to conjugate PEG moieties, typically succinimidyl PEGs, to rHuPH20. For example, rHuPH20 has been conjugated with exemplary succinimidyl monoPEG (mPEG) reagents including mPEG-Succinimidyl Propionates (mPEG-SPA), mPEG-Succinimidyl Butanoates (mPEG-SBA), and (for attaching "branched" PEGs) mPEG2-N-Hydroxylsuccinimide. These PEGylated succinimidyl esters contain different length carbon backbones between the PEG group and the activated cross-linker, and either a single or branched PEG group. These differences can be used, for example, to provide for different reaction kinetics and to potentially restrict sites available for PEG attachment to rHuPH20 during the conjugation process.

Succinimidyl PEGs (as above) comprising either linear or branched PEGs can be conjugated to rHuPH20. PEGs can used to generate rHuPH20s reproducibly containing molecules having, on the average, between about three to six or three to six PEG molecules per hyaluronidase. Such PEGylated rHuPH20 compositions can be readily purified to yield compositions having specific activities of approximately 25,000 or 30,000 Unit/mg protein hyaluronidase activity, and being substantially free of non-PEGylated rHuPH20 (less than 5% non-PEGylated).

Using various PEG reagents, exemplary versions of hyaluronan degrading enzymes, in particular soluble human recombinant hyaluronidases (e.g. rHuPH20), can be prepared, for example, using mPEG-SBA (30 kD), mPEG-SMB (30 kD), and branched versions based on mPEG2-NHS (40 kD) and mPEG2-NHS (60 kD). PEGylated versions of rHuPH20 have been generated using NHS chemistries, as well as carbonates, and aldehydes, using each of the following reagents: mPEG2-NHS-40K branched, mPEG-NHS-10K branched, mPEG-NHS-20K branched, mPEG2-NHS-60K branched; mPEG-SBA-5K, mPEG-SBA-20K, mPEG-SBA-30K; mPEG-SMB-20K, mPEG-SMB-30K; mPEG-butyrldehyde; mPEG-SPA-20K, mPEG-SPA-30K; and PEG-NHS-5K-biotin. PEGylated hyaluronidases have also been prepared using PEG reagents available from Dowpharma, a division of Dow Chemical Corporation; including hyaluronidases PEGylated with Dowpharma's p-nitrophenyl-carbonate PEG (30 kDa) and with propionaldehyde PEG (30 kDa).

In one example, the PEGylation includes conjugation of mPEG-SBA, for example, mPEG-SBA-30K (having a molecular weight of about 30 kDa) or another succinimidyl esters of PEG butanoic acid derivative, to a soluble hyaluronidase. Succinimidyl esters of PEG butanoic acid derivatives, such as mPEG-SBA-30K readily couple to amino groups of proteins. For example, covalent conjugation of m-PEG-SBA-30K and rHuPH20 (which is approximately 60 KDa in size) provides stable amide bonds between rHuPH20 and mPEG, as shown in Scheme 1, below.

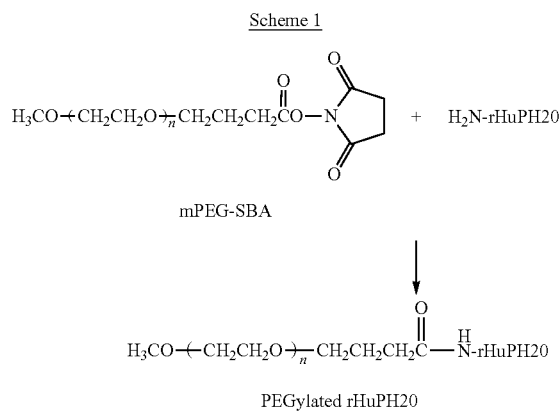

Scheme 1 mPEG-SBA

PEGylated rHuPH20

Typically, the mPEG-SBA-30K or other PEG is added to the hyaluronan degrading enzyme, in some instances a hyaluronidase, at a PEG:polypeptide molar ratio of 10:1 in a suitable buffer, e.g. 130 mM NaCl/10 mM HEPES at pH 6.8 or 70 mM phosphate buffer, pH 7, followed by sterilization, e.g. sterile filtration, and continued conjugation, for example, with stirring, overnight at 4° C. in a cold room. In one example, the conjugated PEG-hyaluronan degrading enzyme is concentrated and buffer-exchanged.

Other methods of coupling succinimidyl esters of PEG butanoic acid derivatives, such as mPEG-SBA-30K are known in the art (see e.g., U.S. Pat. No. 5,672,662; U.S. Pat. No. 6,737,505; and U.S. 2004/0235734). For example, a polypeptide, such as a hyaluronan degrading enzyme (e.g. a hyaluronidase), can be coupled to an NHS activated PEG derivative by reaction in a borate buffer (0.1 M, pH 8.0) for one hour at 4° C. The resulting PEGylated protein can be purified by ultrafiltration. Alternatively, PEGylation of a bovine alkaline phosphatase can be accomplished by mixing the phosphatase with mPEG-SBA in a buffer containing 0.2 M sodium phosphate and 0.5 M NaCl (pH 7.5) at 4° C. for 30 minutes. Unreacted PEG can be removed by ultrafiltration. Another method reacts polypeptide with mPEG-SBA in deionized water to which triethylamine is added to raise the pH to 7.2-9. The resulting mixture is stirred at room temperature for several hours to complete the PEGylation.

Methods for PEGylation of hyaluronan degrading polypeptides, including, for example, animal-derived hyaluronidases and bacterial hyaluronan degrading enzymes, are known to one of skill in the art. See, for example, European Patent No. EP 0400472, which describes the PEGylation of bovine testes hyaluorindase and chondroitin ABC lyase. Also, U.S. Publication No. 2006014968 describes PEGylation of a human hyaluronidase derived from human PH20. For example, the PEGylated hyaluronan-degrading enzyme generally contains at least 3 PEG moieties per molecule. For example, the hyaluronan-degrading enzyme can have a PEG to protein molar ratio between 5:1 and 9:1, for example, 7:1.

E. Corticosteroids

Corticosteroids are a class of steroid hormones that are produced in the adrenal cortex. Corticosteroids are involved in a wide range of physiologic systems such as stress response, immune response and regulation of inflammation, carbohydrate metabolism, protein catabolism, blood electrolyte levels, and behavior. These include glucocorticoids, which are anti-inflammatory agents with a large number of other functions and mineralocorticoids, which control salt and water balance primarily through action on the kidneys.

Glucocorticoids are a class of steroid hormones, e.g., corticosteroids, that bind to the glucocorticoid receptor. Glucocorticoids cause their effects by binding to the glucocorticoid receptor. The activated glucocorticoid complex in turn up-regulates the expression of anti-inflammatory proteins in the nucleus and represses the expression of pro-inflammatory proteins in the cytosol by preventing the translocation of other transcription factors from the cytosol into the nucleus.

Generally, any corticosteroid, e.g., glucocorticoid, can be used in the methods or combinations provided herein. The glucocorticoids include synthetic and non-synthetic glucocorticoids. Exemplary glucocorticoids include, but are not limited to: alclomethasones, algestones, beclomethasones (e.g. beclomethasone dipropionate), betamethasones (e.g. betamethasone 17-valerate, betamethasone sodium acetate, betamethasone sodium phosphate, betamethasone valerate), budesonides, clobetasols (e.g. clobetasol propionate), clobetasones, clocortolones (e.g. clocortolone pivalate), cloprednols, corticosterones, cortisones and hydrocortisones (e.g. hydrocortisone acetate), cortivazols, deflazacorts, desonides, desoximethasones, dexamethasones (e.g. dexamethasone 21-phosphate, dexamethasone acetate, dexamethasone sodium phosphate), diflorasones (e.g. diflorasone diacetate), diflucortolones, difluprednates, enoxolones, fluazacorts, flucloronides, fludrocortisones (e.g., fludrocortisone acetate), flumethasones (e.g. flumethasone pivalate), flunisolides, fluocinolones (e.g. fluocinolone acetonide), fluocinonides, fluocortins, fluocortolones, fluorometholones (e.g. fluorometholone acetate), fluperolones (e.g., fluperolone acetate), fluprednidenes, fluprednisolones, flurandrenolides, fluticasones (e.g. fluticasone propionate), formocortals, halcinonides, halobetasols, halometasones, halopredones, hydrocortamates, hydrocortisones (e.g. hydrocortisone 21-butyrate, hydrocortisone aceponate, hydrocortisone acetate, hydrocortisone buteprate, hydrocortisone butyrate, hydrocortisone cypionate, hydrocortisone hemisuccinate, hydrocortisone probutate, hydrocortisone sodium phosphate, hydrocortisone sodium succinate, hydrocortisone valerate), loteprednol etabonate, mazipredones, medrysones, meprednisones, methylprednisolones (methylprednisolone aceponate, methylprednisolone acetate, methylprednisolone hemisuccinate, methylprednisolone sodium succinate), mometasones (e.g., mometasone furoate), paramethasones (e.g., paramethasone acetate), prednicarbates, prednisolones (e.g. prednisolone 25-diethylaminoacetate, prednisolone sodium phosphate, prednisolone 21-hemisuccinate, prednisolone acetate; prednisolone farnesylate, prednisolone hemisuccinate, prednisolone-21 (beta-D-glucuronide), prednisolone metasulphobenzoate, prednisolone steaglate, prednisolone tebutate, prednisolone tetrahydrophthalate), prednisones, prednivals, prednylidenes, rimexolones, tixocortols, triamcinolones (e.g. triamcinolone acetonide, triamcinolone benetonide, triamcinolone hexacetonide, triamcinolone acetonide 21-palmitate, triamcinolone diacetate). These glucocorticoids and the salts thereof are discussed in detail, for example, in Remington's Pharmaceutical Sciences, A. Osol, ed., Mack Pub. Co., Easton, Pa. (16th ed. 1980).

In some examples, the glucocorticoid is selected from among cortisones, dexamethasones, hydrocortisones, methylprednisolones, prednisolones and prednisones. In a particular example, the glucocorticoid is dexamethasone.

F. Use of Corticosteroids to Ameliorate the Adverse Effects of an Anti-Hyaluronan Agent Provided herein are methods of treatment or uses with corticosteroids, particularly glucocorticoids, e.g., dexamethasone, orally or intravenously, to eliminate or reducer the adverse musculoskeletal effects induced by treatment with an anti-hyaluronan agent, such as PEGylated hyaluronan degrading enzyme. In the methods, the corticosteroid is used in a dosing regime or amount that does not affect the therapeutic effect of the anti-hyaluronan agent, such as hyaluronan degrading enzyme. For example, anti-hyaluronan agents, such as hyaluronan degrading enzymes, and in particular polymer-conjugated such as PEGylated hyaluronan degrading enzymes can be used for single therapy or combination therapy of a hyaluronan-associated disease or condition (see e.g. U.S. published application No. US2010003238 and International published application No. WO2009128917). For example, a corticosteroid can be used to ameliorate side effects or adverse events associated with treatment of a hyaluronan-associated disease or condition, such as a cancer, as described in Section H, and in particular single therapy or combination therapy with a low dose PEGylated hyaluronan degrading enzyme (e.g. PEGPH20) that is found herein to exhibit therapeutic efficacy. Provided herein are pharmaceutical compositions, dosing schemes, and means of administration of corticosteroids to ameliorate or reduce the side effects of administered anti-hyaluronan agents. The compositions can be provided separately or together as part of a kit.

1. Pharmaceutical Compositions and Formulations

Pharmaceutical compositions containing a corticosteroid, particularly glucocorticoids, such as dexamethasone, are provided herein. Corticosteroids, such as glucocorticoids, can be co-formulated or co-administered with pharmaceutical compositions containing an anti-hyaluronan agent, such as a PEGylated hyaluronan degrading enzymes, to ameliorate adverse side effects associated with treatment of hyaluronan associated diseases or disorders with the anti-hyaluronan agent, e.g. PEGylated hyaluronidases.

Also provided herein are pharmaceutical compositions of anti-hyaluronan agents, for example, PEGylated hyaluronan degrading enzymes, such as PEGylated hyaluronidases. Also provided herein are pharmaceutical compositions containing a second agent that is used to treat a disease or disorder associated with a hyaluronan-associated disease or condition, such as cancer. Exemplary of such agents include, but are not limited to, anti-cancer agents including drugs, polypeptides, nucleic acids, antibodies, peptides, small molecules, gene therapy vector, viruses and other therapeutics. Anti-hyaluronan agents, such as PEGylated hyaluronan degrading enzymes, including PEGylated hyaluronidases, such as PEGPH20, can be co-formulated or co-administered with pharmaceutical formulations of such second agents to enhance their delivery to desired sites or tissues within the body associated with excess or accumulated hyaluronan.

Pharmaceutically acceptable compositions are prepared in view of approvals for a regulatory agency or other agency prepared in accordance with generally recognized pharmacopeia for use in animals and in humans. The compounds can be formulated into any suitable pharmaceutical preparations for any of oral and intravenous administration such as solutions, suspensions, powders, or sustained release formulations. Typically, the compounds are formulated into pharmaceutical compositions using techniques and procedures well known in the art (see e.g., Ansel *Introduction to*

*Pharmaceutical Dosage Forms, Fourth Edition,* 1985, 126. The formulation should suit the mode of administration.

In one example, pharmaceutical preparation can be in liquid form, for example, solutions, syrups or suspensions. If provided in liquid form, the pharmaceutical preparations can be provided as a concentrated preparation to be diluted to a therapeutically effective concentration before use. Such liquid preparations can be prepared by conventional means with pharmaceutically acceptable additives such as suspending agents (e.g., sorbitol syrup, cellulose derivatives or hydrogenated edible fats); emulsifying agents (e.g., lecithin or acacia); non-aqueous vehicles (e.g., almond oil, oily esters, or fractionated vegetable oils); and preservatives (e.g., methyl or propyl-p-hydroxybenzoates or sorbic acid). In another example, pharmaceutical preparations can be presented in lyophilized form for reconstitution with water or other suitable vehicle before use.

Pharmaceutical compositions can include carriers such as a diluent, adjuvant, excipient, or vehicle with which the composition (e.g. corticosteroid or anti-hyaluronan agent, such as a PEGylated hyaluronan degrading enzymes) are administered. Examples of suitable pharmaceutical carriers are described in "Remington's Pharmaceutical Sciences" by E. W. Martin. Such compositions will contain a therapeutically effective amount of the compound or agent, generally in purified form or partially purified form, together with a suitable amount of carrier so as to provide the form for proper administration to the patient. Such pharmaceutical carriers can be sterile liquids, such as water and oils, including those of petroleum, animal, vegetable or synthetic origin, such as peanut oil, soybean oil, mineral oil, and sesame oil. Water is a typical carrier. Saline solutions and aqueous dextrose and glycerol solutions also can be employed as liquid carriers, particularly for injectable solutions. Compositions can contain along with an active ingredient: a diluent such as lactose, sucrose, dicalcium phosphate, or carboxymethylcellulose; a lubricant, such as magnesium stearate, calcium stearate and talc; and a binder such as starch, natural gums, such as gum acacia, gelatin, glucose, molasses, polyvinylpyrrolidine, celluloses and derivatives thereof, povidone, crospovidones and other such binders known to those of skill in the art. Suitable pharmaceutical excipients include starch, glucose, lactose, sucrose, gelatin, malt, rice, flour, chalk, silica gel, sodium stearate, glycerol monostearate, talc, sodium chloride, dried skim milk, glycerol, propylene, glycol, water, and ethanol. For example, suitable excipients are, for example, water, saline, dextrose, glycerol or ethanol. A composition, if desired, also can contain other minor amounts of non-toxic auxiliary substances such as wetting or emulsifying agents, pH buffering agents, stabilizers, solubility enhancers, and other such agents, such as for example, sodium acetate, sorbitan monolaurate, triethanolamine oleate and cyclodextrins.

Pharmaceutically acceptable carriers used in parenteral preparations include aqueous vehicles, nonaqueous vehicles, antimicrobial agents, isotonic agents, buffers, antioxidants, local anesthetics, suspending and dispersing agents, emulsifying agents, sequestering or chelating agents and other pharmaceutically acceptable substances. Examples of aqueous vehicles include Sodium Chloride Injection, Ringers Injection, Isotonic Dextrose Injection, Sterile Water Injection, Dextrose and Lactated Ringers Injection. Nonaqueous parenteral vehicles include fixed oils of vegetable origin, cottonseed oil, corn oil, sesame oil and peanut oil. Antimicrobial agents in bacteriostatic or fungistatic concentrations can be added to parenteral preparations packaged in multiple-dose containers, which include phenols or cresols, mercurials, benzyl alcohol, chlorobutanol, methyl and propyl p-hydroxybenzoic acid esters, thimerosal, benzalkonium chloride and benzethonium chloride. Isotonic agents include sodium chloride and dextrose. Buffers include phosphate and citrate. Antioxidants include sodium bisulfate. Local anesthetics include procaine hydrochloride. Suspending and dispersing agents include sodium carboxymethylcelluose, hydroxypropyl methylcellulose and polyvinylpyrrolidone. Emulsifying agents include Polysorbate 80 (TWEENs 80). A sequestering or chelating agent of metal ions include EDTA. Pharmaceutical carriers also include ethyl alcohol, polyethylene glycol and propylene glycol for water miscible vehicles and sodium hydroxide, hydrochloric acid, citric acid or lactic acid for pH adjustment.

Injectables can be prepared in conventional forms, either as liquid solutions or suspensions, solid forms suitable for solution or suspension in liquid prior to injection, or as emulsions. Preparations for intraprostatic administration include sterile solutions ready for injection, sterile dry soluble products, such as lyophilized powders, ready to be combined with a solvent just prior to use, including hypodermic tablets, sterile suspensions ready for injection, sterile dry insoluble products ready to be combined with a vehicle just prior to use, sterile emulsions. The solutions can be either aqueous or nonaqueous.

2. Dosages and Administration

In the methods and uses provided herein, the corticosteroid is administered in an amount to ameliorate, reduce or prevent a side effect or adverse effect of an administered anti-hyaluronan agent. It is understood generally that it is the combination of the particular anti-hyaluronan agent and the route of administration that causes the particular side effect. Exemplary of side effects observed by treatment with anti-hyaluronan agents are musculoskeletal side effects. The dosage or dosage regime at which an anti-hyaluronan agent causes an adverse side effect can be empirically determined by one of skill in the art as described herein (see e.g. Section G). The Examples describe methods to assess and monitor adverse events in various subject and models as exemplified by administration of PEGPH20. Typically, the amount of anti-hyaluronan agent also is an amount that achieves a therapeutic effect, such as by inhibition of HA synthesis or degradation of HA. The amount of corticosteroid that ameliorates, reduces or prevents the observed side effects resulting from the administered anti-hyaluronan agent also can be empirically determined. The amount of corticosteroid is a function of the anti-hyaluronan agent, the route of administration, the observed or measured side effect and the particular patient or subject.

Anti-hyaluronan agents and corticosteroids can be administered by any suitable route of administration, including but not limited to orally, intravenously (IV), subcutaneously, intramuscularly, intra-tumorally, intradermally, topically, transdermally, rectally or sub-epidermally. As described herein, local administration also can be employed, in particular for lower doses of an anti-hyaluronan agent. The route of administration of the anti-hyaluronan agent and corticosteroid can be the same or different. The route of administration of the anti-hyaluronan agent is a function of the anti-hyaluronan agent and the disease or condition to be treated. Likewise, the route of administration of the corticosteroid is a function of the particular corticosteroid and the side effect which is being ameliorated. Typically, the route of administration of the corticosteroid and anti-hyaluronan agent is such so as to achieve a systemic effect. For example, PEGylated hyaluronan degrading enzymes are typically administered intravenously. In another example, glucocorticoids are typically administered orally. Other routes of administration are contemplated, such as any route known to those of skill in the art.

The corticosteroid can be administered sequentially, intermittently, at the same time or in the same composition as the anti-hyaluronan agent, such as the PEGylated hyaluronan degrading enzyme. Compositions also can be administered with other biologically active second agents or treatments, such as chemotherapeutic and biological agents, either sequentially, intermittently, at the same time or in the same composition. Administration also can include controlled release systems including controlled release formulations and device controlled release, such as by means of a pump.

Further, the concentration of the pharmaceutically active agent(s) is adjusted so that administration provides an effective amount to produce the desired pharmacological effect. The exact dose depends on the age, weight and condition of the patient or animal as is known in the art. The unit-dose parenteral preparations are packaged in an ampoule, a vial or a syringe with a needle. The volume of liquid solution or reconstituted powder preparation, containing the pharmaceutically active agent(s), is a function of severity of the disease and the particular article of manufacture chosen for package. All preparations for parenteral administration must be sterile, as is known and practiced in the art.

The pharmaceutical compositions can be formulated in dosage forms appropriate for each route of administration. Pharmaceutically therapeutically active agents and derivatives thereof are typically formulated and administered in unit dosage forms or multiple dosage forms. Each unit dose contains a predetermined quantity of therapeutically active agent sufficient to produce the desired therapeutic effect, in association with the required pharmaceutical carrier, vehicle or diluent. Examples of unit dose forms include ampoules and syringes and individually packaged tablets or capsules. Unit dose forms can be administered in fractions or multiples thereof. A multiple dose form is a plurality of identical unit dosage forms packaged in a single container to be administered in segregated unit dose form. Examples of multiple dose forms include vials, bottles of tablets or capsules or bottles of pints or gallons. Hence, a multiple dose form is a multiple of unit doses that are not segregated in packaging. Generally, dosage forms or compositions containing active ingredient in the range of 0.005% to 100% with the balance made up from non-toxic carrier can be prepared. The therapeutic agent(s) can be formulated as pharmaceutical compositions for single or multiple dosage use.

a. Corticosteroid

A corticosteroid is administered is an amount that is therapeutically effective to ameliorate or reduce the one or more adverse effects of administration of an anti-hyaluronan agent, such as a PEGylated hyaluronan degrading enzymes, in particular, adverse musculoskeletal effects. A therapeutically effective amount is the dosage sufficient to ameliorate, prevent, eliminate or reduce one or more symptoms or adverse effects. Indicators of improvement or successful pretreatment include determination of the failure to manifest a relevant score on the CTCAE scale or a change in grading or severity on the CTCAE scale.

The corticosteroid is provided in a therapeutically effective dose. Therapeutically effective concentration can be determined empirically by testing in known in vitro or in vivo (e.g. animal model) systems. For example, the amount of a selected corticosteroid to be administered to ameliorate the adverse effects can be determined by standard clinical techniques. In addition, animal models can be employed to help identify optimal dosage ranges. The precise dosage, which can be determined empirically, can depend on the particular therapeutic preparation, the regime and dosing schedule, the route of administration and the seriousness of the disease. Methods of assessing such parameters are described in Section G, and exemplified in Examples.

The concentration of a selected therapeutic agent in the composition depends on absorption, inactivation and excretion rates, the physicochemical characteristics, the dosage schedule, and amount administered as well as other factors known to those of skill in the art. For example, it is understood that the precise dosage and duration of treatment is a function of the disease or condition, the tissue being treated, the patient or subject and the anti-hyaluronan agent, including amount and dosage regime. The dose of the corticosteroid also can vary depending on the age and health of the patient, the anti-hyaluronan agent dosing (e.g. PEGylated hyaluronan degrading enzyme dosing), potency of the corticosteroid, and the route of administration. For example, it is to be noted that concentrations and dosage values will vary with the therapeutic dose and dosage regime of the anti-hyaluronan agent, for example, the PEGylated hyaluronan degrading enzyme. Additionally, the corticosteroid can be administered daily, weekly, or monthly or over longer periods of time in order to achieve the desired results. The particular dosage volume can vary and is dependent on the dosage regime, frequency of administration and the desired rate of administration. It is to be noted that concentrations and dosage values can also vary with the age of the individual treated.

The precise dosage and duration of treatment can be determined empirically using known testing protocols or by extrapolation from in vivo or in vitro test data. It is to be further understood that for any particular subject, specific dosage regimens should be adjusted over time according to the individual need and the professional judgment of the person administering or supervising the administration of the formulations, and that the concentration ranges set forth herein are exemplary only and are not intended to limit the scope thereof. Generally, dosage regimens are chosen to limit toxicity, and herein are chosen to ameliorate adverse side effects. It should be noted that the attending physician would know how to and when to terminate, interrupt or adjust therapy to lower dosage due to toxicity, or bone marrow, liver or kidney or other tissue dysfunctions. Conversely, the attending physician would also know how to and when to adjust treatment to higher levels if the clinical response is not adequate (precluding toxic side effects). Administration of a therapeutic agent should not exceed the maximum dosage levels established by the United States Food and Drug Administration or published in the Physician's Desk Reference.

Generally, the dose of corticosteroid administered is dependent upon the specific corticosteroid, as a difference in potency exists between different corticosteroids (see Table 4 below). The corticosteroid, or glucocorticoid, for example dexamethasone, can be given orally (tablets, liquid or liquid concentrate) PO, intravenously (IV) or intramuscularly. The corticosteroid is typically administered as a bolus, but many be administered over a period of time, as long as the dose is effective to ameliorate one or more side effects associated with administration of the anti-hyaluronan agent, for example, a PEGylated hyaluronidase.

TABLE 4

Glucocorticoid administration

| Glucocorticoid (route) | Equivalent Potency (mg) |
|---|---|
| Hydrocortisone (IV or PO) | 20 |
| Prednisone | 5 |
| Prednisolone (IV or PO) | 5 |
| Methylprednisolone sodium succinate (IV) | 4 |
| Dexamethasone (IV or PO) | 0.5-0.75 |

The corticosteroid can be administered in any amount that is effective to ameliorate one or more side effects associated with administration of the anti-hyaluronan agent, for example a PEGylated hyaluronan degrading enzyme. Thus, the corticosteroid, e.g., glucocorticoid, can be administered, for example, at an amount between at or about 0.1 and 100 mgs, per dose, 0.1 to 80 mgs, 0.1 to 60 mgs, 0.1 to 40 mgs, 0.1 to 30 mgs, 0.1 to 20 mgs, 0.1 to 15 mgs, 0.1 to 10 mgs, 0.1 to 5 mgs, 0.2 to 40 mgs, 0.2 to 30 mgs, 0.2 to 20 mgs, 0.2 to 15 mgs, 0.2 to 10 mgs, 0.2 to 5 mgs, 0.4 to 40 mgs, 0.4 to 30 mgs, 0.4 to 20 mgs, 0.4 to 15 mgs, 0.4 to 10 mgs, 0.4 to 5 mgs, 0.4 to 4 mgs, 1 to 20 mgs, 1 to 15 mgs or 1 to 10 mgs, to a 70 kg adult human subject. Typically, the corticosteroid, such as a glucocorticoid is administered at an amount between at or about 0.4 and 20 mgs, for example, at or about 0.4 mgs, 0.5 mgs, 0.6 mgs, 0.7 mgs, 0.75 mgs, 0.8 mgs, 0.9 mgs, 1 mg, 2 mgs, 3 mgs, 4 mgs, 5 mgs, 6 mgs, 7 mgs, 8 mgs, 9 mgs, 10 mgs, 11 mgs, 12 mgs, 13 mgs, 14 mgs, 15 mgs, 16 mgs, 17 mgs, 18 mgs, 19 mgs or 20 mgs per dose, to an average adult human subject.

The corticosteroid can be administered, for example, at a dosage of at or about 0.001 mg/kg (of the subject), 0.002 mg/kg, 0.003 mg/kg, 0.004 mg/kg, 0.005 mg/kg, 0.006 mg/kg, 0.007 mg/kg, 0.008 mg/kg, 0.009 mg/kg, 0.01 mg/kg, 0.015 mg/kg, 0.02 mg/kg, 0.025 mg/kg, 0.03 mg/kg, 0.035 mg/kg, 0.04 mg/kg, 0.045 mg/kg, 0.05 mg/kg, 0.055 mg/kg, 0.06 mg/kg, 0.065 mg/kg, 0.07 mg/kg, 0.075 mg/kg, 0.08 mg/kg, 0.085 mg/kg, 0.09 mg/kg, 0.095 mg/kg, 0.1 mg/kg, 0.15 mg/kg, 0.2 mg/kg, 0.25 mg/kg, 0.30 mg/kg, 0.35 mg/kg, 0.40 mg/kg, 0.45 mg/kg, 0.50 mg/kg, 0.55 mg/kg, 0.60 mg/kg, 0.65 mg/kg, 0.70 mg/kg, 0.75 mg/kg, 0.80 mg/kg, 0.85 mg/kg, 0.90 mg/kg, 0.95 mg/kg, 1 mg/kg, 1.05 mg/kg, 1.1 mg/kg, 1.15 mg/kg, 1.20 mg/kg, 1.25 mg/kg, 1.3 mg/kg, 1.35 mg/kg or 1.4 mg/kg, to an average adult human subject, typically weighing about 70 kg to 75 kg.

The dosage administered administration can vary as long as administration of the corticosteroid ameliorates one or more adverse side effects associated with administration of the anti-hyaluronan agent, such as a PEGylated hyaluronidase. In one example, the dosage of glucocorticoid, for example, dexamethasone, is administered in successively lower dosages per treatment cycle. Hence, in such treatment regimes, the dose of corticosteroid is tapered. For example, dexamethasone is administered prior to administration of an anti-hyaluronan agent, for example a PEGylated hyaluronidase, at an initial dose of 4 mg, and upon each successive administration of the anti-hyaluronan agent, e.g. a PEGylated hyaluronidase, the dexamethasone dose is lowered, such that the dose is 3 mg for the next administration of the anti-hyaluronan agent, e.g. PEGylated hyaluronidase, then 2 mg per administration of anti-hyaluronan agent, e.g. PEGylated hyaluronidase, and then 1 mg per administration of anti-hyaluronan agent, e.g. PEGylated hyaluronidase. Any dose is contemplated as long as the dose of the corticosteroid is effective to reduce one or more side effects associated with administration of the anti-hyaluronan agent, e.g. a PEGylated hyaluronidase.

Time of administration can vary as long as administration of the corticosteroid ameliorates one or more adverse side effects associated with administration of the anti-hyaluronan agent, such as a PEGylated hyaluronidase. The corticosteroid can be administered sequentially, intermittently, at the same time or in the same composition as the anti-hyaluronan agent, e.g. PEGylated hyaluronan degrading enzyme. For example, the corticosteroid can be administered before, during, simultaneously with, or after administration of the anti-hyaluronan agent, e.g. PEGylated hyaluronidase. In another example, the corticosteroid and anti-hyaluronan agent, e.g. PEGylated hyaluronidase are administered intermittently. Generally, the corticosteroid is administered prior to administration of the anti-hyaluronan agent, e.g. PEGylated hyaluronidase. For example, the corticosteroid, e.g., glucocorticoid, such as dexamethasone, can be administered at or about 0.5 minutes, 1 minute, 2 minutes, 3 minutes, 4 minutes, 5 minutes, 6 minutes, 7 minutes, 8 minutes, 9 minutes, 10 minutes, 15 minutes, 20 minutes, 25 minutes, 30 minutes, 45 minutes, 1 hour, 2 hours, 3 hours, 4 hours, 5 hours, 6 hours, 7 hours, 8 hours, 9 hours, 10 hours, 11 hours, 12 hours, 18 hours, 24 hours, 36 hours or more prior to administration of the anti-hyaluronan agent, for example a PEGylated hyaluronan degrading enzyme.

In some examples, the corticosteroid is administered at the same time as administration of the anti-hyaluronan agent, for example a PEGylated hyaluronan degrading enzyme. In this example, the corticosteroid can be administered together with, or separately from, the anti-hyaluronan agent, e.g. a PEGylated hyaluronidase. Typically, the corticosteroid is administered separately from the anti-hyaluronan agent, for example a PEGylated hyaluronan degrading enzyme. In other examples, the corticosteroid is administered at or about 0.5 minutes, 1 minute, 2 minutes, 3 minutes, 4 minutes, 5 minutes, 6 minutes, 7 minutes, 8 minutes, 9 minutes, 10 minutes, 15 minutes, 20 minutes, 25 minutes, 30 minutes, 45 minutes, 1 hour, 2 hours, 3 hours, 4 hours, 5 hours, 6 hours, 7 hours, 8 hours, 9 hours, 10 hours, 11 hours, 12 hours, 18 hours, 24 hours, 36 hours or more after administration of the anti-hyaluronan agent, for example a PEGylated hyaluronan degrading enzyme.

In one example, the corticosteroid is administered prior to administration of anti-hyaluronan agent, for example a PEGylated hyaluronidase. For example, the corticosteroid, e.g., glucocorticoid, for example, dexamethasone, is administered 1 hour prior to the administration of the anti-hyaluronan agent, e.g. a PEGylated hyaluronidase. In another example, the corticosteroid is administered 5 minutes before the administration of the anti-hyaluronan agent, e.g. a PEGylated hyaluronan degrading enzyme. In another example, the corticosteroid is administered both prior to and after the administration of the anti-hyaluronan agent, e.g. a PEGylated hyaluronidase. In this example, the corticosteroid, such as dexamethasone, is administered one to five minutes immediately before administration of the anti-hyaluronan agent, e.g. a PEGylated hyaluronan degrading enzyme and eight hours after administration of the anti-hyaluronan agent, e.g. a PEGylated hyaluronan degrading enzyme. In another example, a corticosteroid, such as dexamethasone, is administered one hour before administration of the anti-hyaluronan agent, e.g. a PEGylated hyaluronan degrading enzyme and eight to twelve hours after administration of the anti-hyaluronan agent, e.g. a PEGylated hyaluronan degrading enzyme.

Any dosing regime is contemplated as long as the time of dosing of the corticosteroid ameliorates the one or more side effects associated with administration of the anti-hyaluronan agent, for example a PEGylated hyaluronidase. In addition, the dose or dosing regime of corticosteroid is one that does not interfere or reduce the therapeutic effect of the anti-hyaluronan agent in treating a hyaluronan associated disease or disorder.

b. Anti-Hyaluronan Agent

In the method herein, the corticosteroid is administered to ameliorate or reduce adverse events associated with an anti-hyaluronan agent. The amount of anti-hyaluronan agent that is administered is in an amount that results in or causes an adverse side effect, such as a musculoskeletal side effect. Typically, the dose of hyaluronan-degrading enzyme is one that also achieves a therapeutic effect in the treatment of a hyaluronan associated disease or condition. Hence, compositions of an anti-hyaluronan agent are included in an amount sufficient to exert a therapeutically useful effect. The composition containing the active agent can include a pharmaceutically acceptable carrier. The compositions of an anti-hyaluronan agent also can include a second agent. Generally, the dosing (amount and dosing regime) of the anti-hyaluronan agent, for example a PEGylated hyaluronan degrading enzyme, will determine the dosing (amount and dosing regime) of the corticosteroid, e.g. a glucocorticoid.

Therapeutically effective concentration of anti-hyaluronan agents can be determined empirically by testing the compounds in known in vitro and in vivo systems, such as the assays provided herein. For example, the concentration of an anti-hyaluronan agent, for example a PEGylated hyaluronan degrading enzyme, such as PEGylated hyaluronidase depends on absorption, inactivation and excretion rates of the complex, the physicochemical characteristics of the complex, the dosage schedule, and amount administered as well as other factors known to those of skill in the art. For example, it is understood that the precise dosage and duration of treatment is a function of the tissue being treated, the disease or condition being treated, the route of administration, the patient or subject and the particular anti-hyaluronan agent and can be determined empirically using known testing protocols or by extrapolation from in vivo or in vitro test data and/or can be determined from known dosing regimes of the particular agent. The amount of an anti-hyaluronan agent, for example a PEGylated hyaluronan degrading enzyme, such as a PEGylated hyaluronidase, to be administered for the treatment of a disease or condition, for example a hyaluronan-associated disease or condition such as an HA-rich tumor, can be determined by standard clinical techniques. In addition, in vitro assays and animal models can be employed to help identify optimal dosage ranges. The precise dosage, which can be determined empirically, can depend on the particular enzyme, the route of administration, the type of disease to be treated and the seriousness of the disease.

For example, agents and treatments for treatment of hyaluronan-associated diseases and conditions, such as anti-cancer agents, are well known in the art (see e.g. U.S. published application No. 20100003238 and International published PCT Appl. No. WO 2009/128917). Thus, dosages of an anti-hyaluronan agent, such as a hyaluronan-degrading enzyme for example a hyaluronidase, or other second agents in a composition can be chosen based on standard dosing regimes for that agent under a given route of administration. Also, as described in Section H below, it is found herein that far lower doses of a hyaluronan degrading enzyme, for example, exhibit therapeutic efficacy for the treatment of hyaluronan-associated disease and condition. Hence, dosage regimens using lower doses of a hyaluronan degrading enzyme, for example a polymer-modified hyaluronan-degrading enzyme such as a PEGylated PH20, can be used to treat a hyaluronan-associated disease and condition. As described herein, any of such dosage or dosage regimen can be associated with adverse events, such as musculoskeletal side effects, which can be ameliorated by premedication, co-administration and/or post-medication of a corticosteroid.

Examples of effective amounts of an anti-hyaluronan agent is a dose ranging from 0.01 µg to 100 g per kg of body weight. For example, an effective amount of an anti-hyaluronan agent is a dose ranging from 0.01 µg to 100 mg per kg of body weight, such as 0.01 µg to 1 mg per kg of body weight, 1 µg to 100 µg per kg of body weight, 1 µg to 10 µg per kg of body weight or 0.01 mg to 100 mg per kg of body weight. For example, effective amounts include at least or about at least or about or 0.01 µg, 0.05, 0.1, 0.5, 1, 2, 3, 4, 5, 6, 7, 8, 9, 10, 20, 25, 30, 35, 40, 45, 50, 55, 60, 65, 70, 75, 80, 85, 90, 95, 100, 200, 300, 400, 500, 600, 700, 800, 900 or 1000 µg/kg body weight., Other examples of effective amounts include 0.01, 0.02, 0.03, 0.04, 0.05, 0.06, 0.07, 0.08, 0.09, 0.1, 0.2, 0.3, 0.4, 0.5, 0.6, 0.7, 0.8, 0.9, 1.0, 2, 3, 4, 5, 6, 7, 8, 9, 10, 20, 25, 30, 35, 40, 45, 50, 55, 60, 65, 70, 75, 80, 85, 90, 95 or 100 g/kg body weight. For example, an anti-hyaluronan agent, such as a hyaluronan-degrading enzyme for example a hyaluronidase (e.g. a PEGylated hyaluronidase such as a PEGPH20), can be administered at or about 0.1 µg/kg to 1 mg/kg, for example 0.5 µg/kg to 100 µg/kg, 0.75 µg/kg to 15 µg/kg, 0.75 µg/kg to 7.5 µg/kg or 1.0 µg/kg to 3.0 µg/kg. In other examples, an anti-hyaluronan agent such as a hyaluronan-degrading enzyme for example a hyaluornidase (e.g. a PEGylated hyaluronidase such as a PEGPH20), can be administered at or 1 mg/kg to 500 mg/kg, for example, 100 mg/kg to 400 mg/kg, such as 200 mg/kg. Generally, compositions contain 0.5 mg to 100 grams of anti-hyaluronan agent, for example, 20 µg to 1 mg, such as 100 µg to 0.5 mg or can contain 1 mg to 1 gram, such as 5 mg to 500 mg.

The dose or compositions can be for single dosage administration or for multiple dosage administration. The dose or composition can be administered in a single administration once, several times a week, twice weekly, every 15 days, 16 days, 17, 18, 19, 20, 21, 22, 23, 24, 25, 26, 27, 28, 29, or 30 days, once monthly, several times a year or yearly. In other examples, the dose or composition an be divided up and administered once, several times a week, twice weekly, every 15 days, 16 days, 17, 18, 19, 20, 21, 22, 23, 24, 25, 26, 27, 28, 29, or 30 days, once monthly, several times a year or yearly. Anti-hyaluronan compositions can be formulated as liquid compositions or can be lyophilized. The compositions also can be formulated as a tablet or capsule.

Provided below is description of dosages and dosage regimines of exemplary anti-hyaluronan agents for use in the methods herein. The anti-hyaluronan agents can be used alone in a single agent therapy or in combination with other agents for use in treating an HA-associated disease or condition. As discussed elsewhere herein, in particular examples of the methods and uses herein, that agents are administered in combination with a corticosteroid in order to ameliorate a side-effect associated with treatment of the anti-hyaluronan-agent.

i. Leflunomide and Derivatives

In one example, leflunomide, or derivatives thereof, generally are available as tablets containing 1-100 mg of active drug, for example, 1, 5, 10, 20, 30, 40, 50, 60, 70, 80, 90 or 100 mg of drug. For the treatment of hyaluronan associated diseases and conditions, for example Rheumatoid arthritis, it is administered at 10 to 500 mg per day, typically 100 mg per day. The dosage can be continued as needed for treatment of the disease or conditions, or can be tapered or reduced to successively lower doses. For example, for treatment of Rheumatoid arthritis, leflunomide can be administered at an initial loading dose of 100 mg per day for three days and then administered at a continued dose of 20 mg/day.

ii. Hyaluronan-Degrading Enzyme

For example, a hyaluronan-degrading enzyme, such as a PEGylated hyaluronan degrading enzyme (e.g. a hyaluronidase), can be administered systemically, for example, intravenously (IV), intramuscularly, or by any another systemic route. In particular examples, lower doses can be given locally. For example, local administration of a hyaluronan-degrading enzyme, such as a PEGylated hyaluronan degrading enzyme for example a PEGylated hyaluronidase (e.g. PH20) includes intratumoral administration, arterial injection (e.g. hepatic artery), intraperitoneal administration, intravesical administration and other local routes used for cancer therapy that can increase local action at a lower absolute dose.

Exemplary dosage range is at or about 0.3 Units/kg to 320,000 Units/kg, such as 10 Units/kg to 320,000 Units/kg of a PEGylated hyaluronidase, or a functionally equivalent amount of another PEGylated hyaluronan degrading enzyme. It is understood herein that a unit of activity is normalized to a standard activity, for example, an activity as measured in a microturbidity assay assaying hyaluronidase activity. A PEGylated soluble hyaluronidase can exhibit lower activity per mg of total protein, i.e. exhibits a lower specific activity, compared to a native soluble hyaluronidase not so conjugated. For example, an exemplary rHuPH20 preparation exhibits a specific activity of 120,000 Units/mg, while a PEGylated form of rHuPH20 exhibits a specific activity of at or about 32,000 Units/mg. Typically, a PEGylated form of a hyaluronan-degrading enzyme, such as a hyaluronidase for example rHuPH20, exhibits a specific activity within the range of between at or about 18,000 and at or about 45,000 U/mg. In one example, the PEG-hyaluronan degrading enzyme can be provided as a stock solution for example, at 3.5 mg/mL at 112,000 U/mL (~32,000 U/mg), with a PEG to protein molar ratio between 5:1 and 9:1, for example, 7:1, or can be provided in a less concentrated form. For purposes herein, dosages can be with reference to Units.

For example, PEGylated hyaluronan degrading enzyme, such as a hyaluronidase, for example PEGPH20, can be administered intravenously twice weekly, once weekly or once every 21 days. Typically, the PEGylated hyaluronan degrading enzyme is administered twice weekly. The cycle of administration can be for a defined period, generally for 3 weeks or 4 weeks. The cycle of administration can be repeated in a dosage regime for more than one month, 2 months, 3 months, 4 months, 5 months, 6 months, 7 months, 8 months, 9 months, 10 months, 11 months, 1 year or more. Generally, the cycle of administration is repeated at the discretion of a treating physician, and can depend on factors such as remission of the disease or condition, severity of the disease or condition, adverse events and other factors. In other examples, in subsequent cycles of administration, the hyaluronan-degrading enzyme can be administered less frequently. For example, in a first cycle the hyaluronan-degrading enzyme is administered twice weekly for four weeks, and in subsequent cycles of administration the hyaluronan-degrading enzyme is administered once weekly or once every two weeks, once every 3 weeks (e.g. once every 21 days) or once every 4 weeks. As described herein, the dose or dosing regime of corticosteroid is dependent on the dosing regime of hyaluronan-degrading enzyme.

While dosages can vary depending on the disease and patient, the hyaluronan-degrading enzyme, such as a PEGylated hyaluronidase, is generally administered in an amount that is or is about in the range of from 0.01 µg/kg to 25 mg/kg, such as 0.0005 mg/kg (0.5 µg/kg) to 10 mg/kg (320,000 U/kg), for example, 0.02 mg/kg to 1.5 mg/kg, for example, 0.05 mg/kg. The PEGylated hyaluronidase can be administered, for example, at a dosage of at or about 0.0005 mg/kg (of the subject), 0.0006 mg/kg, 0.0007 mg/kg, 0.0008 mg/kg, 0.0009 mg/kg, 0.001 mg/kg, 0.0016 mg/kg, 0.002 mg/kg, 0.003 mg/kg, 0.004 mg/kg, 0.005 mg/kg, 0.006 mg/kg, 0.007 mg/kg, 0.008 mg/kg, 0.009 mg/kg, 0.01 mg/kg, 0.016 mg/kg, 0.02 mg/kg, 0.03 mg/kg, 0.04 mg/kg, 0.05 mg/kg, 0.06 mg/kg, 0.07 mg/kg, 0.08 mg/kg, 0.09 mg/kg, 0.1 mg/kg, 0.15 mg/kg, 0.2 mg/kg, 0.25 mg/kg, 0.30 mg/kg, 0.35 mg/kg, 0.40 mg/kg, 0.45 mg/kg, 0.5 mg/kg, 0.55 mg kg, 0.6 mg/kg, 0.7 mg/kg, 0.8 mg/kg, 0.9 mg/kg, 1.0 mg/kg, 1.1 mg/kg, 1.2 mg/kg, 1.3 mg/kg, 1.4 mg/kg, 1.5 mg/kg, 1.6 mg/kg, 1.7 mg/kg, 1.8 mg/kg, 1.9 mg/kg, 2 mg/kg, 2.5 mg/kg, 3 mg/kg, 3.5 mg/kg, 4 mg/kg, 4.5 mg/kg, 5 mg/kg, 5.5 mg/kg, 6 mg/kg, 6.5 mg/kg, 7 mg/kg, 7.5 mg/kg, 8 mg/kg, 8.5 mg/kg, 9 mg/kg, 9.5 mg/kg, 10 mg/kg, 11 mg/kg, 12 mg/kg, 13 mg/kg, 14 mg/kg, 15 mg/kg, 16 mg/kg, 17 mg/kg, 18 mg/kg, 19 mg/kg, 20 mg/kg, 21 mg/kg, 22 mg/kg, 23 mg/kg, 24 mg/kg, 25 mg/kg, or more is administered, to an average adult human subject, typically weighing about 70 kg to 75 kg. In particular examples, as described in Section H herein, the hyaluronan-degrading enzyme is administered in lower amounts such as less than 20 µg/kg, for example 0.01 µg/kg to 15 µg/kg, 0.05 µg/kg to 10 µg/kg, 0.75 µg/kg to 7.5 µg/kg or 1.0 µg/kg to 3.0 µg/kg.

A hyaluronan-degrading enzyme, such as a PEGylated hyaluronidase (e.g. PH20), provided herein, for example, PEGPH20, can be administered at or about 1 Unit/kg to 800,000 Units/kg, such as 10 to 800,000 Units/kg, 10 to 750,000 Units/kg, 10 to 700,000 Units/kg, 10 to 650,000 Units/kg, 10 to 600,000 Units/kg, 10 to 550,000 Units/kg, 10 to 500,000 Units/kg, 10 to 450,000 Units/kg, 10 to 400,000 Units/kg, 10 to 350,000 Units/kg, 10 to 320,000 Units/kg, 10 to 300,000 Units/kg, 10 to 280,000 Units/kg, 10 to 260,000 Units/kg, 10 to 240,000 Units/kg, 10 to 220,000 Units/kg, 10 to 200,000 Units/kg, 10 to 180,000 Units/kg, 10 to 160,000 Units/kg, 10 to 140,000 Units/kg, 10 to 120,000 Units/kg, 10 to 100,000 Units/kg, 10 to 80,000 Units/kg, 10 to 70,000 Units/kg, 10 to 60,000 Units/kg, 10 to 50,000 Units/kg, 10 to 40,000 Units/kg, 10 to 30,000 Units/kg, 10 to 20,000 Units/kg, 10 to 15,000 Units/kg, 10 to 12,800 Units/kg, 10 to 10,000 Units/kg, 10 to 9,000 Units/kg, 10 to 8,000 Units/kg, 10 to 7,000 Units/kg, 10 to 6,000 Units/kg, 10 to 5,000 Units/kg, 10 to 4,000 Units/kg, 10 to 3,000 Units/kg, 10 to 2,000 Units/kg, 10 to 1,000 Units/kg, 10 to 900 Units/kg, 10 to 800 Units/kg, 10 to 700 Units/kg, 10 to 500 Units/kg, 10 to 400 Units/kg, 10 to 300 Units/kg, 10 to 200 Units/kg, 10 to 100 Units/kg, 16 to 600,000 Units/kg, 16 to 500,000 Units/kg, 16 to 400,000 Units/kg, 16 to 350,000 Units/kg, 16 to 320,000 Units/kg, 16 to 160,000 Units/kg, 16 to 80,000 Units/kg, 16 to 40,000 Units/kg, 16 to 20,000 Units/kg, 16 to 16,000 Units/kg, 16 to 12,800 Units/kg, 16 to 10,000 Units/kg, 16 to 5,000 Units/kg, 16 to 4,000 Units/kg, 16 to 3,000 Units/kg, 16 to 2,000 Units/kg, 16 to 1,000 Units/kg, 16 to 900 Units/kg, 16 to 800 Units/kg, 16 to 700 Units/kg, 16 to 500 Units/kg, 16 to 400 Units/kg, 16 to 300 Units/kg, 16 to 200 Units/kg, 16 to 100 Units/kg, 160 to 12,800 Units/kg, 160 to 8,000 Units/kg, 160 to 6,000 Units/kg, 160 to 4,000 Units/kg, 160 to 2,000 Units/kg, 160 to 1,000 Units/kg, 160 to 500 Units/kg, 500 to 5000 Units/kg, 1000 to 100,000 Units/kg or 1000 to 10,000 Units/kg, of the mass of the subject to whom it is administered. In some examples, a hyaluronan-degrading enzyme, such as a PEGylated hyaluronidase (e.g. PH20), provided herein, for example, PEGPH20, can be administered at or about 1 Unit/kg to 1000 Units/kg, 1 Units/kg to 500 Units/kg or 10 Units/kg to 50 Units/kg.

Generally, where the specific activity of the PEGylated hyaluronidase is or is about 18,000 U/mg to 45,000 U/mg, generally at or about 1 Units/kg (U/kg), 2 U/kg, 3 U/kg, 4 U/kg, 5 U/kg, 6 U/kg, 7 U/kg, 8 U/kg, 8 U/kg 10 U/kg, 16 U/kg, 32 U/kg, 64 U/kg, 100 U/kg, 200 U/kg, 300 U/kg, 400 U/kg, 500 U/kg, 600 U/kg, 700 U/kg, 800 U/kg, 900 U/kg, 1,000 U/kg, 2,000 U/kg, 3,000 U/kg, 4,000 U/kg, 5,000 U/kg, 6,000 U/kg, 7,000 U/kg, 8,000 U/kg, 9,000 U/kg, 10,000 U/kg, 12,800 U/kg, 20,000 U/kg, 32,000 U/kg, 40,000 U/kg, 50,000 U/kg, 60,000 U/kg, 70,000 U/kg, 80,000 U/kg, 90,000 U/kg, 100,000 U/kg, 120,000 U/kg, 140,000 U/kg, 160,000 U/kg, 180,000 U/kg, 200,000 U/kg, 220,000 U/kg, 240,000 U/kg, 260,000 U/kg, 280,000 U/kg, 300,000 U/kg, 320,000 U/kg, 350,000 U/kg, 400,000 U/kg, 450,000 U/kg, 500,000 U/kg, 550,000 U/kg, 600,000 U/kg, 650,000 U/kg, 700,000 U/kg, 750,000 U/kg, 800,000 U/kg or more, per mass of the subject, is administered.

In some aspects, the PEGylated hyaluronan degrading enzyme is formulated and dosed to maintain at least 3 U/mL of the PEGylated hyaluronidase in the plasma (see e.g. published U.S. Patent App. No. US20100003238 and published International Patent App. No. WO2009128917). For example, the PEGylated soluble hyaluronidase is formulated for systemic administration in a sufficient amount to maintain at least or about 3 U/mL in the plasma, generally 3 U/mL-12 U/mL or more, for example, from at least or about or at a level of 4 U/mL, 5 U/mL, 6 U/mL, 7 U/mL, 8 U/mL, 9 U/mL, 10 U/mL, 11 U/mL, 12 U/mL, 13 U/mL, 14 U/mL, 15 U/mL, 16 U/mL, 17 U/mL, 18 U/mL, 19 U/mL, 20 U/mL, 25 U/mL, 30 U/mL, 35 U/mL, 40 U/mL, 45 U/mL, 50 U/mL or more. Generally, for purposes herein to maintain at least 3 U/mL of the hyaluronidase in plasma, at or about 0.02 mg/kg (of the subject), 0.03 mg/kg, 0.04 mg/kg, 0.05 mg/kg, 0.06 mg/kg, 0.07 mg/kg, 0.08 mg/kg, 0.09 mg/kg, 0.1 mg/kg, 0.15 mg/kg, 0.2 mg/kg, 0.25 mg/kg, 0.30 mg/kg, 0.35 mg/kg, 0.40 mg/kg, 0.45 mg/kg, 0.5 mg/kg, 0.55 mg/kg, 0.6 mg/kg, 0.7 mg/kg, 0.8 mg/kg, 0.9 mg/kg, 1.0 mg/kg, 1.1 mg/kg, 1.2 mg/kg, 1.3 mg/kg, 1.4 mg/kg, 1.5 mg/kg or more is administered. Generally, where the specific activity of the modified hyaluronidase is or is about 20,000 U/mg to 60,000 U/mg, generally at or about 35,000 U/mg, 60,000 U; 70,000 U; 80,000 U; 90,000 U; 100,000 U; 200,000 U; 300,000 U; 400,000 U; 500,000 U; 600,000 U; 700,000 U; 800,000 U; 900,000 U; 1,000,000 U; 1,500,000 U; 2,000,000 U; 2,500,000 U; 3,000,000 U; 3,500,000 U; 4,000,000 U or more is administered. To maintain such levels, administration can be daily, several times a week, twice weekly, weekly or monthly.

It is within the level of one of skill in the art to determine the amounts of PEGylated hyaluron degrading enzyme, for example, PEGylated PH20, to maintain at least 3 U/mL of the hyaluronidase in the blood. The level of hyaluronidase in the blood can be monitored over time in order to ensure that a sufficient amount of the hyaluronidase is present in the blood. Any assay known to one of skill in the art to measure the hyaluronidase in the plasma can be performed. For example, a microturbidity assay or enzymatic assay described in the Examples herein can be performed on protein in plasma. It is understood that plasma normally contains hyaluronidase enzymes. Such plasma hyaluronidase enzymes typically have activity at an acidic pH (U.S. Pat. No. 7,105,330). Hence, before treatment of with a modified enzyme, the plasma levels of hyaluronidase should be determined and used as a baseline. Subsequent measurements of plasma hyaluronidase levels after treatment can be compared to the levels before treatments. Alternatively, the assay can be performed under pH conditions that suppress endogenous lysosomal hyaluronidase activity in plasma, which normally exhibits activity at acidic pH. Thus, where the modified soluble hyaluronidase is active at neutral pH (e.g. human PH20), only the level of the modified neutral-active soluble hyaluronidase is measured.

In other examples, as described in Section H herein, the PEGylated hyaluronan degrading enzyme is formulated and administered at a lower dose, which is found herein to have therapeutic effects to treat a hyaluronan-associated disease or conditions absent a detectable level of hyaluronidase maintained in the blood. For example, the PEGylated soluble hyaluronidase is administered in an amount that is less than 20 µg/kg, for example 0.01 µg/kg to 15 µg/kg, 0.05 µg/kg to 10 µg/kg, 0.75 µg/kg to 7.5 µg/kg or 1.0 µg/kg to 3.0 µg/kg, such as at or about 0.01 µg/kg (of the subject), 0.02 µg/kg, 0.03 µg/kg, 0.04 µg/kg, 0.05 µg/kg, 1.0 µg/kg, 1.5 µg/kg, 2.0 µg/kg, 2.5 µg/kg, 3.0 µg/kg, 3.5 µg/kg, 4.0 µg/kg, 4.5 µg/kg, 5.0 µg/kg, 5.5 µg/kg, 6.0 µg/kg, 7.0 µg/kg, 7.5 µg/kg, 8.0 µg/kg, 9.0 µg/kg, 10.0 µg/kg, 12.5 µg/kg or 15 µg/kg. Generally, where the specific activity of the modified hyaluronidase is or is about 20,000 U/mg to 60,000 U/mg, generally at or about 35,000 U/mg, 200 Units to 50,000 (U) is administered, such as 200 U, 300 U; 400 U; 500 U; 600 U; 700 U; 800 U; 900 U; 1,000 U; 1250 U; 1500 U; 2000 U; 3000 U; 4000 U; 5,000 U; 6,000 U; 7,000 U; 8,000 U; 9,000 U; 10,000 U; 20,000 U; 30,000 U; 40,000 U; or 50,000 U is administered. To maintain such levels, administration can be daily, several times a week, twice weekly, weekly or monthly.

Typically, volumes of injections or infusions of PEGylated hyaluronidase contemplated herein are from at or about 0.5 mL, 1 mL, 2 mL, 3 mL, 4 mL, 5 mL, 6 mL, 7 mL, 8 mL, 9 mL, 10 mL, 15 mL, 20 mL, 30 mL, 40 mL, 50 mL or more. The PEGylated hyaluronan degrading enzyme, such as a PEGylated hyaluronidase can be provided as a stock solution at or about 50 U/mL, 100 U/mL, 150 U/mL, 200 U/mL, 400 U/mL or 500 U/mL (or a functionally equivalent amount) or can be provided in a more concentrated form, for example at or about 1000 U/mL, 2000 Units/mL, 3000 U/mL, 4000 U/mL, 5000 U/mL, 6000 U/mL, 7000 U/mL, 8000 U/mL, 9000 U/mL, 10,000 U/mL, 11,000 U/mL, 12,000 U/mL, or 12,800 U/mL, for use directly or for dilution to the effective concentration prior to use. The volume of PEGylated hyaluronan degrading enzyme, such as PEGylated hyaluronidase, administered is a function of the dosage required, but can be varied depending on the concentration of a hyaluronan degrading enzyme, such as soluble hyaluronidase, stock formulation available. For example, it is contemplated herein that the PEGylated hyaluronan degrading enzyme, such as PEGylated hyaluronidase, is not administered in volumes greater than about 50 mL, and typically is administered in a volume of 5-30 mL, generally in a volume that is not greater then about 10 mL. The PEGylated hyaluronan degrading enzyme, such as a PEGylated hyaluronidase, can be provided as a liquid or lyophilized formulation. Lyophilized formulations are ideal for storage of large unit doses of PEGylated hyaluronan degrading enzymes.

3. Combination Treatment

Anti-hyaluronan agents, such as a hyaluronan-degrading enzymes for example a PEGylated hyaluronan degrading enzyme (e.g. PEGylated hyaluronaidase such as PEGPH20) can be administered in a combination treatment, for example, for the treatment of a hyaluronan-associated disease or condition. As described herein, a corticosteroid can be administered to ameliorate side effects or adverse events of the anti-hyaluronan agent in the combination therapy.

For example, compositions of an anti-hyaluronan agent described herein can be further co-formulated or co-administered together with, prior to, intermittently with, or subsequent to, other therapeutic or pharmacologic agents or treatments, such as procedures, for example, agents or treatments to treat a hyaluronan associated disease or condition, for example hyaluronan-associated cancers. Such agents include, but are not limited to, other biologics, anti-cancer agents, small molecule compounds, dispersing agents, anesthetics, vasoconstrictors and surgery, and combinations thereof. Such other agents and treatments that are available for the treatment of a disease or condition, including all those exemplified herein, are known to one of skill in the art or can be empirically determined.

A preparation of a second agent or agents or treatment or treatments can be administered at once, or can be divided into a number of smaller doses to be administered at intervals of time. Selected agent/treatment preparations can be administered in one or more doses over the course of a treatment time for example over several hours, days, weeks, or months. In some cases, continuous administration is useful. It is understood that the precise dosage and course of administration depends on the indication and patient's tolerability. Generally, dosing regimes for second agents/treatments herein are known to one of skill in the art.

In one example, an anti-hyaluronan agent, such as a PEGylated hyaluronan degrading enzyme, such as PEGylated hyaluronidase, is administered as part of a combination therapy, by administering the anti-hyaluronan agent (e.g. a PEGylated hyaluronan degrading enzyme) and a second agent or treatment for treating the disease or condition. In one example, the anti-hyaluronan agent, such as a PEGylated hyaluronan degrading enzyme, and second agent or treatment can be co-formulated and administered together. In another example, the anti-hyaluronan agent, such as a PEGylated hyaluronan degrading enzyme, such as PEGylated hyaluronidase, is administered subsequently, intermittently or simultaneously with the second agent or treatment preparation. Generally, the anti-hyaluronan agent, for example a PEGylated hyaluronan degrading enzyme, is administered prior to administration of the second agent or treatment preparation to permit the anti-hyaluronan agent, for example a PEGylated hyaluronan degrading enzyme, to reduce or degrade the hyaluronic acid in a cell, tissue or fluid of the subject, such as, for example, the interstitial space, extracellular matrix, tumor tissue, blood or other tissue. For example, an anti-hyaluronan agent, such as a PEGylated hyaluronan degrading enzyme, such as soluble hyaluronidase, can be administered 0.5 minutes, 1 minute, 2 minute, 3 minute, 4 minute, 5 minute, 6 minute, 7 minutes, 8 minutes, 9 minutes, 10 minutes, 20 minutes, 30 minutes, 1 hour or more prior to administration of the second agent preparation. In some examples, the anti-hyaluronan agent, for example a PEGylated hyaluronan degrading enzyme, is administered together with the second agent preparation. As will be appreciated by those of skill in the art, the desired proximity of co-administration depends in significant part in the effect half lives of the agents in the particular tissue setting, and the particular disease being treated, and can be readily optimized by testing the effects of administering the agents at varying times in suitable models, such as in suitable animal models. In some situations, the optimal timing of administration of the anti-hyaluronan agent, for example a PEGylated hyaluronan degrading enzyme, such as a PEGylated hyaluronidase, will exceed 60 minutes.

Anti-Cancer Agents and Other Treatments

The anticancer agent(s) or treatment(s) can be surgery, radiation, drugs, chemotherapeutics, polypeptides, antibodies, peptides, small molecules or gene therapy vectors, viruses or DNA.

Exemplary anti-cancer agents that can be administered after, coincident with or before administration of the PEGylated hyaluronan degrading enzyme, such as a PEGylated hyaluronidase, include, but are not limited to Acivicins; Avicin; Aclarubicins; Acodazoles; Acronines; Adozelesins; Aldesleukins; Alemtuzumabs; Alitretinoins (9-Cis-Retinoic Acids); Allopurinols; Altretamines; Alvocidibs; Ambazones; Ambomycins; Ametantrones; Amifostines; Aminoglutethimides; Amsacrines; Anastrozoles; Anaxirones; Ancitabines; Anthramycins; Apaziquones; Argimesnas; Arsenic Trioxides; Asparaginases; Asperlins; Atrimustines; Azacitidines; Azetepas; Azotomycins; Banoxantrones; Batabulins; Batimastats; BCG Live; Benaxibines; Bendamustines; Benzodepas; Bexarotenes; Bevacizumab; Bicalutamides; Bietaserpines; Biricodars; Bisantrenes; Bisantrenes; Bisnafide Dimesylates; Bizelesins; Bleomycins; Bortezomibs; Brequinars; Bropirimines; Budotitanes; Busulfans; Cactinomycins; Calusterones; Canertinibs; Capecitabines; Caracemides; Carbetimers; Carboplatins; Carboquones; Carmofurs; Carmustines with Polifeprosans; Carmustines; Carubicins; Carzelesins; Cedefingols; Celecoxibs; Cemadotins; Chlorambucils; Cioteronels; Cirolemycins; Cisplatins; Cladribines; Clanfenurs; Clofarabines; Crisnatols; Cyclophosphamides; Cytarabine liposomals; Cytarabines; Dacarbazines; Dactinomycins; Darbepoetin Alfas; Daunorubicin liposomals; Daunorubicins/Daunomycins; Daunorubicins; Decitabines; Denileukin Diftitoxes; Dexniguldipines; Dexonnaplatins; Dexrazoxanes; Dezaguanines; Diaziquones; Dibrospidiums; Dienogests; Dinalins; Disermolides; Docetaxels; Dofequidars; Doxifluridines; Doxorubicin liposomals; Doxorubicin HCL; Doxorubicin HCL liposome injection; Doxorubicins; Droloxifenes; Dromostanolone Propionates; Duazomycins; Ecomustines; Edatrexates; Edotecarins; Eflornithines; Elacridars; Elinafides; Elliott's B Solutions; Elsamitrucins; Emitefurs; Enloplatins; Enpromates; Enzastaurins; Epipropidines; Epirubicins; Epoetin alfas; Eptaloprosts; Erbulozoles; Esorubicins; Estramustines; Etanidazoles; Etoglucids; Etoposide phosphates; Etoposide VP-16s; Etoposides; Etoprines; Exemestanes; ExisulindS; Fadrozoles; Fazarabines; Fenretinides; Filgrastims; Floxuridines; Fludarabines; Fluorouracils; 5-fluorouracils; Fluoxymesterones; Fluorocitabines; Fosquidones; Fostriecins; Fostriecins; Fotretamines; Fulvestrants; Galarubicins; Galocitabines; Gemcitabines; Gemtuzumabs/Ozogamicins; Geroquinols; Gimatecans; Gimeracils; Gloxazones; Glufosfamides; Goserelin acetates; Hydroxyureas; Ibritumomabs/Tiuxetans; Idarubicins; Ifosfamides; Ilmofosines; Ilomastats; Imatinib mesylates; Imexons; Improsulfans; Indisulams; Inproquones; Interferon alfa-2 as; Interferon alfa-2bs; Interferon Alfas; Interferon Betas; Interferon Gammas; Interferons; Interleukin-2s and other Interleukins (including recombinant Interleukins); Intoplicines; Iobenguanes [131-I]; Iproplatins; Irinotecans; Irsogladines; Ixabepilones; Ketotrexates; L-Alanosines; Lanreotides; Lapatinibs; Ledoxantrones; Letrozoles; Leucovorins; Leuprolides; Leuprorelins (Leuprorelides); Levamisoles; Lexacalcitols; Liarozoles; Lobaplatins; Lometrexols; Lomustines/CCNUs; Lomustines; Lonafarnibs; Losoxantrones; Lurtotecans; Mafosfamides; Mannosulfans; Marimastats; Masoprocols; Maytansines; Mechlorethamines; Mechlorethamines/Nitrogen mustards; Megestrol acetates; Megestrols; Melengestrols; Melphalans; MelphalansIL-PAMs; Menogarils; Mepitiostanes; Mercaptopurines; 6-Mercaptopurine; Mesnas; Metesinds; Methotrexates; Methoxsalens; Metomidates; Metoprines; Meturedepas; Miboplatins; Miproxifenes; Misonidazoles; Mitindomides; Mitocarcins; Mitocromins; Mitoflaxones; Mitogillins; Mitoguazones; Mitomalcins; Mitomycin Cs; Mitomycins; Mitonafides; Mitoquidones; Mitospers; Mitotanes; Mitoxantrones; Mitozolomides; Mivobulins; Mizoribines; Mofarotenes; Mopidamols; Mubritinibs; Mycophenolic Acids; Nandrolone Phenpropionates; Nedaplatins; Nelzarabines; Nemorubicins; Nitracrines; Nocodazoles; Nofetumomabs; Nogalamycins; Nolatrexeds; Nortopixantrones; Octreotides; Oprelvekins; Ormaplatins; Ortataxels; Oteracils; Oxaliplatins; Oxisurans; Oxophenarsines; Paclitaxels; Pamidronates; Patubilones; Pegademases; Pegaspargases; Pegfilgrastims; Peldesines; Peliomycins; Pelitrexols; Pemetrexeds; Pentamustines; Pentostatins; Peplomycins; Perfosfamides; Perifosines; Picoplatins; Pinafides; Pipobromans; Piposulfans; Pirfenidones; Piroxantrones; Pixantrones; Plevitrexeds; Plicamycid Mithramycins; Plicamycins; Plomestanes; Plomestanes; Porfimer sodiums; Porfimers; Porfiromycins; Prednimustines; Procarbazines; Propamidines; Prospidiums; Pumitepas; Puromycins; Pyrazofurins; Quinacrines; Ranimustines; Rasburicases; Riboprines; Ritrosulfans; Rituximabs; Rogletimides; Roquinimexs; Rufocromomycins; Sabarubicins; Safingols; Sargramostims; Satraplatins; Sebriplatins; Semustines; Simtrazenes; Sizofurans; Sobuzoxanes; Sorafenibs; Sparfosates; Sparfosic Acids; Sparsomycins; Spirogermaniums; Spiromustines; Spiroplatins; Spiroplatins; Squalamines; Streptonigrins; Streptovaricyns; Streptozocins; Sufosfamides; Sulofenurs; Sunitinib Malate; 6-thioguanine (6-TG); Tacedinalines; Talcs; Talisomycins; Tallimustines; Tamoxifens; Tariquidars; Tauromustines; Tecogalans; Tegafurs; Teloxantrones; Temoporfins; Temozolomides; Teniposides/VM-26s; Teniposides; Teroxirones; Testolactones; Thiamiprines; Thioguanines; Thiotepas; Tiamiprines; Tiazofurins; Tilomisoles; Tilorones; Timcodars; Timonacics; Tirapazamines; Topixantrones; Topotecans; Toremifenes; Tositumomabs; Trabectedins (Ecteinascidin 743); Trastuzumabs; Trestolones; Tretinoins/ATRA; Triciribines; Trilostanes; Trimetrexates; Triplatin Tetranitrates; Triptorelins; Trofosfamides; Tubulozoles; Ubenimexs; Uracil Mustards; Uredepas; Valrubicins; Valspodars; Vapreotides; Verteporfins; Vinblastines; Vincristines; Vindesines; Vinepidines; Vinflunines; Vinformides; Vinglycinates; Vinleucinols; Vinleurosines; Vinorelbines; Vinrosidines; Vintriptols; Vinzolidines; Vorozoles; Xanthomycin As (Guamecyclines); Zeniplatins; Zilascorbs [2-H]; Zinostatins; Zoledronate; Zorubicins; and Zosuquidars, for example:

Aldesleukins (e.g. PROLEUKIN®); Alemtuzumabs (e.g. CAMPATH®); Alitretinoins (e.g. PANRETIN®); Allopurinols (e.g. ZYLOPRIM®); Altretamines (e.g. HEXALEN®); Amifostines (e.g. ETHYOL®); Anastrozoles (e.g. ARIMIDEX®); Arsenic Trioxides (e.g. TRISENOX®); Asparaginases (e.g. ELSPAR®); BCG Live (e.g. TICE® BCG); Bexarotenes (e.g. TARGRETIN®); Bevacizumab (AVASTIN®); Bleomycins (e.g. BLENOXANE®); Busulfan intravenous (e.g. BUSULFEX®); Busulfan orals (e.g. MYLERAN®); Calusterones (e.g. METHOSARB®); Capecitabines (e.g. XELODA®); Carboplatins (e.g. PARAPLATIN®); Carmustines (e.g. BCNU®, BiCNU®); Carmustines with Polifeprosans (e.g. GLIADEL® Wafer); Celecoxibs (e.g. CELEBREX®); Chlorambucils (e.g. LEUKERAN®); Cisplatins (e.g. PLATINOL®); Cladribines (e.g. LEUSTATIN®, 2-CdA®); Cyclophosphamides (e.g. CYTOXAN®, NEOSAR®); Cytarabines (e.g. CYTOSAR-U®); Cytarabine liposomals (e.g. DepoCyt®); Dacarbazines (e.g. DTIC-Dome): Dactinomycins (e.g. COSMEGEN®); Darbepoetin Alfas (e.g. ARANESP®); Daunorubicin liposomals (e.g. DANUOXOME®); Daunorubicins/Daunomycins (e.g. CERUBIDINE®); Denileukin Diftitoxes (e.g. ONTAK®); Dexrazoxanes (e.g. ZINECARD®); Docetaxels (e.g. TAXOTERE®); Doxorubicins (e.g. ADRIAMYCIN®, RUBEX®); Doxorubicin liposomals, including Doxorubicin HCL liposome injections (e.g. DOXIL®); Dromostanolone propionates (e.g. DROMOSTANOLONE® and MASTERONE® Injection); Elliott's B Solutions (e.g. Elliott's B Solution®); Epirubicins (e.g. ELLENCE®); Epoetin alfas (e.g. EPOGEN®); Estramustines (e.g. EMCYT®); Etoposide phosphates (e.g. ETOPOPHOS®); Etoposide VP-16s (e.g. VEPESID®); Exemestanes (e.g. AROMASIN®); Filgrastims (e.g. NEUPOGEN®); Floxuridines (e.g. FUDR®); Fludarabines (e.g. FLUDARA®); Fluorouracils incl. 5-FUs (e.g. ADRUCIL®); Fulvestrants (e.g. FASLODEX®); Gemcitabines (e.g. GEMZAR®); Gemtuzumabs/Ozogamicins (e.g. MYLOTARG®); Goserelin acetates (e.g. ZOLADEX®); Hydroxyureas (e.g. HYDREA®); Ibritumomabs/Tiuxetans (e.g. ZEVALIN®); Idarubicins (e.g. IDAMYCIN®); Ifosfamides (e.g. IFEX®); Imatinib mesylates (e.g. GLEEVEC®); Interferon alfa-2 as (e.g. ROFERON-A®); Interferon alfa-2bs (e.g. INTRON A®); Irinotecans (e.g. CAMPTOSAR®); Letrozoles (e.g. FEMARA®); Leucovorins (e.g. WELLCOVORIN®, LEUCOVORIN®); Levamisoles (e.g. ERGAMISOL®); Lomustines/CCNUs (e.g. CeeBU®); Mechlorethamines/Nitrogen mustards (e.g. MUSTARGEN®); Megestrol acetates (e.g. MEGACE®); Melphalans/L-PAMs (e.g. ALKERAN®); Mercaptopurine, including 6-mercaptopurines (6-MPs; e.g. PURINETHOL®); Mesnas (e.g. MESNEX®); Methotrexates; Methoxsalens (e.g. UVADEX®); Mitomycin Cs (e.g. MUTAMYCIN®, MITOZYTREX®); Mitotanes (e.g. LYSODREN®); Mitoxantrones (e.g. NOVANTRONE®); Nandrolone Phenpropionates (e.g. DURABOLIN-50®); Nofetumomabs (e.g. VERLUMA®); Oprelvekins (e.g. NEUMEGA®); Oxaliplatins (e.g. ELOXATIN®); Paclitaxels (e.g. PAXENE®, TAXOL®); Pamidronates (e.g. AREDIA®); Pegademases (e.g. ADAGEN®); Pegaspargases (e.g. ONCASPAR®); Pegfilgrastims (e.g. NEULASTA®); Pentostatins (e.g. NIPENT®); Pipobromans (e.g. VERCYTE®); Plicamycin/Mithramycins (e.g. MITHRACIN®); Porfimer sodiums (e.g. PHOTOFRIN®); Procarbazines (e.g. MATULANE®); Quinacrines (e.g. ATABRINE®); Rasburicases (e.g. ELITEK®); Rituximabs (e.g. RITUXAN®); Sargramostims (e.g. PROKINE®); Streptozocins (e.g. ZANOSAR®); Sunitinib Malates (e.g. SUTENT®); Talcs (e.g. SCLEROSOL®); Tamoxifens (e.g. NOLVADEX®); Temozolomides (e.g. TEMODAR®); Teniposides/VM-26s (e.g. VUMON®); Testolactones (e.g. TESLAC®); Thioguanines including, 6-thioguanine (6-TG); Thiotepas (e.g. THIOPLEX®); Topotecans (e.g. HYCAMTIN®); Toremifenes (e.g. FARESTON®); Tositumomabs (e.g. BEXXAR®); Trastuzumabs (e.g. HERCEPTIN®); Tretinoins/ATRA (e.g. VESANOID®); Uracil Mustards;

Valrubicins (e.g. VALSTAR®); Vinblastines (e.g. VELBAN®); Vincristines (e.g. ONCOVIN®); Vinorelbines (e.g. NAVELBINE®); and Zoledronates (e.g. ZOMETA®).

4. Packaging and Articles of Manufacture

Also provided are articles of manufacture containing packaging materials, any pharmaceutical composition or combination provided herein, and a label that indicates that the compositions and combinations are to be used for treatment of side effects associated with administration of an anti-hyaluronan agent, for example a PEGylated hyaluronan degrading enzyme, and/or for treating a hyaluronan-associated disease or condition. Exemplary of articles of manufacture are containers including single chamber and dual chamber containers. The containers include, but are not limited to, tubes, bottles and syringes. The containers can further include a needle for subcutaneous administration.

In one example, pharmaceutical composition contains the corticosteroid and no second agent or treatment. In another example, the article of manufacture contains pharmaceutical compositions containing the corticosteroid and the anti-hyaluronan agent, for example a PEGylated hyaluronan degrading enzyme. In this example, the corticosteroid and the anti-hyaluronan agent, for example a PEGylated hyaluronan degrading enzyme, can be provided together or separately, for packaging as articles of manufacture. In another example, the article of manufacture contains the corticosteroid, anti-hyaluronan agent (e.g. a PEGylated hyaluronan degrading enzyme) and a second agent or agents or treatment or treatments. In this example, the corticosteroid, anti-hyaluronan agent (e.g. a PEGylated hyaluronan degrading enzyme) and a second agent or agents or treatment or treatments, can be provided together or separately, for packaging as articles of manufacture.

In one example, the pharmaceutical composition contains the anti-hyaluronan agent (e.g. a PEGylated hyaluronan degrading enzyme), and no second agent or treatment. In another example, the article of manufacture contains the anti-hyaluronan agent (e.g. a PEGylated hyaluronan degrading enzyme) and a second agent or agents or treatment or treatments. In this example, the pharmaceutical compositions of a second agent and an anti-hyaluronan agent, for example a PEGylated hyaluronan degrading enzyme, such as a PEGylated hyaluronidase, can be provided together or separately, for packaging as articles of manufacture.

The articles of manufacture provided herein contain packaging materials. Packaging materials for use in packaging pharmaceutical products are well known to those of skill in the art. See, for example, U.S. Pat. Nos. 5,323,907, 5,052,558 and 5,033,252, each of which is incorporated herein in its entirety. Examples of pharmaceutical packaging materials include, but are not limited to, blister packs, bottles, tubes, inhalers, pumps, bags, vials, containers, syringes, bottles, and any packaging material suitable for a selected formulation and intended mode of administration and treatment.

The choice of package depends on the corticosteroid, such as a glucocorticoid and other agents, and whether such compositions will be packaged together or separately. In general, the packaging is non-reactive with the compositions contained therein. In other examples, some of the components can be packaged as a mixture. In other examples, all components are packaged separately. Thus, for example, the components can be packaged as separate compositions that, upon mixing just prior to administration, can be directly administered together. Alternatively, the components can be packaged as separate compositions for administration separately.

The components can be packaged in a container. The components are separately packaged in the same container. Generally, examples of such containers include those that have an enclosed, defined space that contains glucocorticoid, and a separate enclosed, defined space containing the other components or component such that the subsequent areas are separated by a readily removable membrane which, upon removal, permits the components to mix. Any container or other article of manufacture is contemplated, so long as the glucocorticoid is separated from the other components prior to administration. For suitable embodiments see e.g., containers described in U.S. Pat. Nos. 3,539,794 and 5,171,081.

Selected compositions including articles of manufacture thereof also can be provided as kits. Kits can include a pharmaceutical composition described herein and an item for administration provided as an article of manufacture. The kit can, optionally, include instructions for application including dosages, dosing regimens and instructions for modes of administration. Kits also can include a pharmaceutical composition described herein and an item for diagnosis.

G. Methods of Assessing Activity and Effects of Anti-Hyaluronan Agents and Corticosteroids Provided herein are methods for treating a subject with a corticosteroid, for example a glucocorticoid such as dexamethasone, to ameliorate, and/or eliminate adverse effects resulting from an administered anti-hyaluronan agent. For example, systemic administration of PEGylated hyaluronidase is associated with musculoskeletal side effects including, for example, muscle and joint pain, stiffness of upper and lower extremities, cramping, myositis, muscle soreness and tenderness over the entire body, weakness, fatigue and/or a decrease in range of motion at knee and elbow joints. In such methods, the corticosteroid is generally administered to ameliorate side effects without eliminating the activities of the anti-hyaluronan agent to reduce hyaluronan by inhibiting its synthesis or degrading hyaluronan. It is within the level of one of skill in the art to assess whether corticosteroids ameliorate such side effects, including without interfering with the activity of an anti-hyaluronan agent, such as a PEGylated hyaluronidase. For example, various animal models and clinical studies in humans can be performed. In addition to assessing the amelioration of side effects, efficacy, tolerability and pharmacokinetic studies of an anti-hyaluronan agent can be performed in the presence or absence of varying doses of corticosteroid.

In particular, PEGylated hyaluronan is a therapeutic agent either alone, or in combination with secondary agents such as chemotherapeutic drugs, for the treatment of hyaluronan-associated diseases and conditions, in particular cancers (see for example, US 2010/0003238 and WO09/128,917). Hence, amelioration of side effects of PEGylated hyaluronidase with corticosteroids permits the use of PEGylated hyaluronidase in such treatments while minimizing the systemic, for example musculoskeletal, side effects of the PEGylated hyaluronidase. Studies, including in animal models of a hyaluronan-associated disease such as cancer, can be performed to assess the efficacy of PEGylated hyaluronidase, alone or in combination with chemotherapeutic agents, and in the presence or absence of corticosteroid treatment.

1. Methods to Assess Side Effects

In vivo assays can be used to assess the efficacy of corticosteroids on the amelioration or elimination of the musculoskeletal side effects. Side effects that can be assessed include, for example, muscle and joint pain, stiffness of upper and lower extremities, cramping, myositis, muscle soreness and tenderness over the entire body, weakness, fatigue and/or a decrease in range of motion at knee and elbow joints. Assays to assess side effects can include animal models wherein the animal can be observed for reduced movement, behavior or posture changes, radiographic findings, histopathological changes and other notable clinical observations. Other assays can include clinical trials in human subjects wherein patients can be questioned regarding symptoms, assessed by physical examination, imaging (for example by MRI or PET) or by radiologic evaluation. Amelioration of a side effect caused by administration of an anti-hyaluronan agent is observed when the side effect is ameliorated, eliminated, lessened or reduced in the presence of the corticosteroid compared to in its absence.

In such examples, the dose of anti-hyaluronan agent and/or corticosteroid can be varied to identify the optimal or minimal dose required to achieve activity while ameliorating side effects. Such studies are within the level of one of skill in the art. Further, the dosage regime can be varied. For example, studies can be performed using a dosage schedule of anti-hyaluronan agent monthly, biweekly, once a week, twice a week, three times a week, four times a week or more. Further, the corticosteroid can be administered prior to, concurrently and/or subsequent to administration of the anti-hyaluronan agent. The Examples exemplify such studies in animal models and human patients.

For example, in vivo animal models can be utilized to assess the ability of corticosteroids, such as dexamethasone, to ameliorate or eliminate the side effects associated with anti-hyaluronan agent administration. Animal models can include non-human primates such as cynomolgus monkeys or rhesus macaques, dogs, for example beagle dogs, or any other animal that exhibits adverse side effects in response to PEGylated hyaluronidase treatment. The animal models can be dosed with an anti-hyaluronan agent in the presence or absence of corticosteroid and musculoskeletal effects observed or measured.

For example, animals such as cynomolgus monkeys, beagles or other similar animal model capable of observable or measurable musculoskeletal events can be treated with an anti-hyaluronan agent in the presence or absence of corticosteroid. In one example, a group of animals, for example cynomolgus monkeys or beagles, is administered with an anti-hyaluronan agent alone, for example a PEGylated hyaluronidase, such as by intravenous administration. For example, administration can be twice weekly. Treatment can continue until changes in limb joint range-of-motion are observed at the knee and elbow joints or stiffness or reduced mobility is observed. Then, another group of animals can be treated with the anti-hyaluronan agent and corticosteroid administered, such as by oral doses of dexamethasone or other corticosteroid, given on the same day as the anti-hyaluronan agent administration. The groups of animals can then be compared for example, via physical examination of joint range-of-motion or other reduced mobility, histopathology of the joints, palpation for stiffness, or imaging known to those of skill in the art, to assess the ability of the corticosteroid, such as dexamethasone, to ameliorate the anti-hyaluronan agent-mediated musculoskeletal side effects. Dose, dosing frequency, route of administration, and timing of dosing of corticosteroid, such as dexamethasone, can be varied to optimize the effectiveness of the corticosteroid.

In another example, the efficacy of corticosteroids such as dexamethasone on the amelioration or elimination of the adverse side effects associated with anti-hyaluronan agent administration can be assessed in human patients with solid tumors. For example, a clinical trial can be designed to examine the ability of corticosteroid to ameliorate and/or eliminate anti-hyaluronan agent-mediated adverse events including, but not limited to any one or more of the following: muscle and joint pain/stiffness of upper and lower extremities, cramping, muscle, myositis muscle soreness and tenderness over the entire body, weakness and fatigue. Patients can be treated with anti-hyaluronan agent with or without co-treatment with a corticosteroid such as dexamethasone. During and after administration of anti-hyaluronan agent, side effects of both treatment groups can be assessed. A physician can determine the severity of the symptoms by physical examination of the subject including for example, patient complaints, vital signs, changes in body weight, 12-lead ECG, echocardiogram, clinical chemistry, or imaging (MRI, PET or radiologic evaluation). The severity of symptoms can then be quantified using the NCI Common Terminology Criteria for Adverse Events (CTCAE) grading system. The CTCAE is a descriptive terminology utilized for Adverse Event (AE) reporting. A grading (severity) scale is provided for each AE term. The CTCAE displays Grades 1 through 5, with clinical descriptions for severity for each adverse event based on the following general guideline: Grade 1 (Mild AE); Grade 2 (Moderate AE); Grade 3 (Severe AE); Grade 4 (Life-threatening or disabling AE); and Grade 5 (Death related to AE). The ability of a corticosteroid to ameliorate adverse side effects associated with administration of an anti-hyaluronan agent can be measured by the observation of a reduction in grading or severity on the CTCAE scale in one or more adverse side effects in subjects treated with the anti-hyaluronan agent and corticosteroid as compared to subjects treated with the anti-hyaluronan alone, i.e., the severity of the side effects, is reduced from Grade 3 to Grade 1 or Grade 2. This is exemplified in the Examples herein.

In another example, clinical trials can be designed to assess tolerability by escalating the dose of anti-hyaluronan agent and assessing the dose-limiting toxicity. In such an example, a maximum tolerated dose of anti-hyaluronan agent that can be tolerated in the presence of an ameliorating agent such as a corticosteroid can be determined. Treatment regimens can include a dose escalation wherein each enrolled patient receives a higher dose of anti-hyaluronan agent at the same dose level of corticosteroid. Patients can be monitored for adverse events to determine the highest dose of anti-hyaluronan agent that can be administered with a corticosteroid before side effects are no longer tolerated. Tolerability can be measured based on the severity of symptoms emerging during and after treatment. Doses of anti-hyaluronan agent can be escalated until adverse effects reach a predetermined level, for example, Grade 3. Dosing regimens can also include a tapering of the amount of corticosteroid administered to examine the continued need for corticosteroid and the possibility of acclimation to the anti-hyaluronan agent with respect to resulting side effects.

2. Anti-Hyaluronan Activity

In addition to assays to assess the effect of corticosteroids on ameliorating the side effects of an anti-hyaluronan agent, other assays can be performed separately or in conjugation with those mentioned above to assess the effects of corticosteroids on hyaluronan inhibition or degradation activity. Such assays can include, but are not limited to, measuring amounts of hyaluronan in tissue or tumor biopsies or soluble hyaluronan in plasma, measurements of hyaluronan catabolites in blood or urine, measurements of hyaluronidase activity in plasma, or measurements of interstitial fluid pressure, vascular volume or water content in tumors. Other assays such as measurements of pharmacokinetics, methods for which are well known to those of skill in the art, can be used to assess the effects of corticosteroids on anti-hyaluronan agent pharmacokinetic parameters.

a. Assays to Assess the Activity of a Hyaluronan Degrading Enzyme

The activity of a hyaluronan degrading enzyme can be assessed using methods well known in the art. For example, the USP XXII assay for hyaluronidase determines activity indirectly by measuring the amount of undegraded hyaluronic acid, or hyaluronan, (HA) substrate remaining after the enzyme is allowed to react with the HA for 30 min at 37° C. (USP XXII-NF XVII (1990) 644-645 United States Pharmacopeia Convention, Inc, Rockville, Md.). A Hyaluronidase Reference Standard (USP) or National Formulary (NF) Standard Hyaluronidase solution can be used in an assay to ascertain the activity, in units, of any hyaluronidase. In one example, activity is measured using a microturbididy assay. This is based on the formation of an insoluble precipitate when hyaluronic acid binds with albumin. The activity is measured by incubating hyaluronidase or a sample containing hyaluronidase, for example blood or plasma, with sodium hyaluronate (hyaluronic acid) for a set period of time (e.g. 10 minutes) and then precipitating the undigested sodium hyaluronate with the addition of acidified serum albumin. The turbidity of the resulting sample is measured at 640 nm after an additional development period. The decrease in turbidity resulting from hyaluronidase activity on the sodium hyaluronate substrate is a measure of hyaluronidase enzymatic activity.

In another example, hyaluronidase activity is measured using a microtiter assay in which residual biotinylated hyaluronic acid is measured following incubation with hyaluronidase or a sample containing hyaluronidase, for example, blood or plasma (see e.g. Frost and Stern (1997) Anal. Biochem. 251:263-269, U.S. Patent Publication No. 20050260186). The free carboxyl groups on the glucuronic acid residues of hyaluronic acid are biotinylated, and the biotinylated hyaluronic acid substrate is covalently coupled to a microtiter plate. Following incubation with hyaluronidase, the residual biotinylated hyaluronic acid substrate is detected using an avidin-peroxidase reaction, and compared to that obtained following reaction with hyaluronidase standards of known activity. Other assays to measure hyaluronidase activity also are known in the art and can be used in the methods herein (see e.g. Delpech et al., (1995) Anal. Biochem. 229:35-41; Takahashi et al., (2003) Anal. Biochem. 322:257-263).

The ability of an active hyaluronan degrading enzyme, such as a modified soluble hyaluronidase (eg PEGylated rHuPH20) to act as a spreading or diffusing agent also can be assessed. For example, trypan blue dye can be injected, such as subcutaneously or intradermally, with or without a hyaluronan degrading enzyme into the lateral skin on each side of nude mice. The dye area is then measured, such as with a microcaliper, to determine the ability of the hyaluronan degrading enzyme to act as a spreading agent (see e.g. U.S. Published Patent No. 20060104968).

The above assays can be performed using a hyaluronan degrading enzyme in the presence or absence of a corticosteroid or using the blood or plasma of a patient or animal treated with hyaluronidase with or without a corticosteroid.

b. Assays in Animal Models

Animal models of hyaluronan-associated diseases, disorders or conditions can be utilized to assess the in vivo affect of administration of an anti-hyaluronan agent, such as a modified hyaluronidase or PEGylated hyaluronidase, with or without co-administration of a corticosteroid. Another agent, such as a chemotherapeutic agent can also be included in the assessment of activity. Exemplary hyaluronan-associated diseases for which an appropriate animal model can be utilized include solid tumors, for example, late-stage cancers, metastatic cancers, undifferentiated cancers, ovarian cancer, in situ carcinoma (ISC), squamous cell carcinoma (SCC), prostate cancer, pancreatic cancer, non-small cell lung cancer, breast cancer, colon cancer and other cancers. Also exemplary of hyaluronan-associated diseases and disorders are inflammatory diseases, disc pressure, cancer and edema, for example, edema caused by organ transplant, stroke, brain trauma or other injury.

Animal models can include, but are not limited to, mice, rats, rabbits, dogs, guinea pigs and non-human primate models, such as cynomolgus monkeys or rhesus macaques. In some examples, immunodeficient mice, such as nude mice or SCID mice, are transplanted with a tumor cell line from a hyaluronan-associated cancer to establish an animal model of that cancer. Exemplary cell lines from hyaluronan-associated cancers include, but are not limited to, PC3 prostate carcinoma cells, BxPC-3 pancreatic adenocarcinoma cells, MDA-MB-231 breast carcinoma cells, MCF-7 breast tumor cells, BT474 breast tumor cells, Tramp C2 prostate tumor cells and Mat-LyLu prostate cancer cells, and other cell lines described herein that are hyaluronan associated, e.g. contain elevated levels of hyaluronan. Anti-hyaluronan agents can then be administered to the animal with or without a corticosteroid such as dexamethasone, to assess the effects of the corticosteroid on anti-hyaluronan activity by measuring, for example, hyaluronan levels or content. Hyaluronan content can be measured by staining tumor tissue samples for hyaluronan or by measuring soluble hyaluronan levels in plasma. Other measurements of anti-hyaluronan activity include the assessment of tumor volume, formation or size of halos, interstitial fluid pressure, water content and/or vascular volume. Assays such as those mentioned above are demonstrated in Example 9.

In other examples, dogs such as beagle dogs, can be treated with an anti-hyaluronan agent in the presence or absence of a corticosteroid, such as dexamethasone. Tissues such as skin or skeletal muscle tissue are biopsied and stained for hyaluronan and evaluated visually. Tissues from animals treated with an anti-hyaluronan agent alone are then compared to tissues from aminals treated with the anti-hyaluronan agent and corticosteroid to measure the effect of the corticosteroid on anti-hyaluronan activity. These assays are demonstrated in Example 8.

c. Assays in Humans

Clinical trials such as those described in Section G1 above, performed to assess the ability of corticosteroids to ameliorate anti-hyaluronan-mediated adverse effects, can concurrently be used to assay the activity of anti-hyaluronan agent in the presence of a corticosteroid. Assays to measure anti-hyaluronan activity in patients with solid tumors, treated for example, with an anti-hyaluronan agent with or without corticosteroids, with escalating doses of anti-hyaluronan agent and a fixed amount of corticosteroid, or with a fixed amount of anti-hyaluronan agent and tapering doses of corticosteroid, can be performed. These assays can include tumor tissue biopsy assays where tumor biopsies are taken before treatment, during treatment and after treatment. Tissues are stained to measure hyaluronan levels in the tumor to assess the activity of the administered anti-hyaluronan agent. Stained tumor tissues biopsied before, during and after treatment can be compared to evaluate anti-hyaluronan activity in the presence of corticosteroids.

In another example, blood and urine can be collected at different time points throughout patient treatment and assayed for catabolites of hyaluronan. The presence of catabolites is indicative of the degradation of hyaluronan and is thus a measure of the activity of hyaluronidase. Plasma enzyme also can be assessed and measured over time following administration. The Examples exemplify these assays.

Additional methods of assessing the anti-hyaluronan activity include assays that assess the diffusion of water in tissues. As discussed elsewhere herein, tissues that accumulate hyaluronan generally have a higher interstitial fluid pressure than normal tissue due to the concomitant accumulation of water. Thus, tissues that accumulate HA, such as tumors, have high interstitial fluid pressure, which can be measured by various methods known in the art. For example, diffusion MRI, such as ADC MRI or DCE MRI, can be used. Diffusion of water can be assessed by these procedures, and is directly correlated to presence of hyaluronan-rich tissues, such as solid tumors (see e.g. Chenevert et al. (1997) Clinical Cancer Research, 3:1457-1466). For example, tumors that accumulate hyaluronan have a distinguishable increase in ADC MRI or DCE MRI because of increased perfusion. Such assays can be performed in the presence and absence of an anti-hyaluronan agent with or without corticosteroid, and results compared. Methods of measuring diffusion are a useful measure of assessing cellular changes following such therapies.

d. Pharmacokinetics

Pharmacokinetic studies can be performed using animal models or can be performed during clinical studies with patients to assess the effect of co-administration of a corticosteroid on the pharmacokinetic properties of a modified hyaluronan degrading enzyme, such as a modified hyaluronidase. Animal models include, but are not limited to, mice, rats, rabbits, dogs, guinea pigs and non-human primate models, such as cynomolgus monkeys or rhesus macaques. In some instances, pharmacokinetic studies are performed using healthy animals. In other examples, the studies are performed using animal models of a disease for which therapy with hyaluronan is considered, such as animal models of any hyaluronan-associated disease or disorder.

The pharmacokinetic properties of an anti-hyaluronan agent, such as a modified hyaluronidase, in the presence of a corticosteroid, can be assessed by measuring such parameters as the maximum (peak) concentration ($C_{max}$), the peak time (i.e. when maximum concentration occurs; $T_{max}$), the minimum concentration (i.e. the minimum concentration between doses; $C_{min}$), the elimination half-life ($T_{1/2}$) and area under the curve (i.e. the area under the curve generated by plotting time versus concentration; AUC), following administration. In instances where the modified hyaluronidase might be administered subcutaneously, the absolute bioavailability of the hyaluronidase is determined by comparing the area under the curve of hyaluronidase following subcutaneous delivery ($AUC_{sc}$) with the AUC of hyaluronidase following intravenous delivery ($AUC_{iv}$). Absolute bioavailability (F), can be calculated using the formula: $F=([AUC]_{sc} \times dose_{sc})/([AUC]_{iv} \times dose_{iv})$.

A range of doses and different dosing frequency of dosing can be administered in the pharmacokinetic studies to assess the effect of increasing or decreasing concentrations of the corticosteroid, such as dexamethasone and/or anti-hyaluronan agent (e.g. PEGylated rHuPH20) in the dose. Pharmacokinetic properties of anti-hyaluronan agents, such as bioavailability, also can be assessed with or without co-administration of corticosteroid. For example, dogs, such as beagles, can be administered an anti-hyaluronan agent, such as a PEGylated hyaluronidase, alone, or together with a corticosteroid, using one or more routes of administration. Such studies can be performed to assess the effect of co-administration of corticosteriods with anti-hyaluronan agent on pharmacokinetic properties. Additionally, the effect of co-administration of an anti-hyaluronan agent, such as a hyaluronidase, with another agent, such as a chemotherapeutic, in the presence or absence of a corticosteroid, on the pharmacokinetic and pharmacodynamic properties of that agent also can be assessed in vivo using animal model and/or human subjects, such as in the setting of a clinical trial, as discussed above.

H. Use of Anti-Hyaluronan Agents in Treating Hyaluronan-Associated Conditions, Diseases and Disorders Anti-Hyaluronan agents, such as a PEGylated hyaluronan degrading enzyme, can be used to treat hyaluronan-associated diseases or conditions, alone or in combination with therapeutic agents. In particular, modified hyaluronan degrading enzymes, such as a PEGPH20, has anti-tumor activity alone or in combination with chemotherpeutic agents (see e.g. U.S. published application No. US20100003238 and International published application No. WO2009128917).

As found herein, anti-tumor activity is observed at doses far lower than previously contemplated that do not achieve or maintain a detectable level of hyaluronidase enzyme in the plasma. Hence, the extent of adverse side effects, such as musculoskeletal side effects, is not as severe as higher doses of enzyme. At these lower doses, the enzyme exhibits pharmacokinetic and pharmacodynamic properties that correlate to a reduction in tumor associated hyaluronan (HA), elevation in plasma hyaluronan, and favorable changes in tumor volumes and incidence.

Hence, provided herein is a method or use for treating a hyaluronan-associated disease or condition, such as a cancer, by administering a polymer-modified hyaluronan-degrading enzyme, such as a polymer-modified hyaluoronidase for example a PH20 (e.g. PEGPH20) to a patient in an amount less than 20 µg/kg, for example 0.01 µg/kg to 15 µg/kg, 0.05 µg/kg to 10 µg/kg, 0.75 µg/kg to 7.5 µg/kg or 1.0 µg/kg to 3.0 µg/kg, such as at or about 0.01 µg/kg (of the subject), 0.02 µg/kg, 0.03 µg/kg, 0.04 µg/kg, 0.05 µg/kg, 1.0 µg/kg, 1.5 µg/kg, 2.0 µg/kg, 2.5 µg/kg, 3.0 µg/kg, 3.5 µg/kg, 4.0 µg/kg, 4.5 µg/kg, 5.0 µg/kg, 5.5 µg/kg, 6.0 µg/kg, 7.0 µg/kg, 7.5 µg/kg, 8.0 µg/kg, 9.0 µg/kg, 10.0 µg/kg, 12.5 µg/kg or 15 µg/kg. For example, a polymer-modified hyaluronan-degrading enzyme, such as a PEGylated hyaluronidase (e.g. PH20), provided herein, for example, PEGPH20, can be administered at or about 1 Unit/kg to 1000 Units/kg, 1 Units/kg to 500 Units/kg or 10 Units/kg to 50 Units/kg. Generally, where the specific activity of the modified hyaluronidase is or is about 20,000 U/mg to 60,000 U/mg, generally at or about 35,000 U/mg, 200 Units to 50,000 (U) is administered, such as 200 U, 300 U; 400 U; 500 U; 600 U; 700 U; 800 U; 900 U; 1,000 U; 1250 U; 1500 U; 2000 U; 3000 U; 4000 U; 5,000 U; 6,000 U; 7,000 U; 8,000 U; 9,000 U; 10,000 U; 20,000 U; 30,000 U; 40,000 U; or 50,000 U is administered. Typically, volumes for injection or infusion are less than 50 mL, such as from at or about 0.5 mL, 1 mL, 2 mL, 3 mL, 4 mL, 5 mL, 6 mL, 7 mL, 8 mL, 9 mL, 10 mL, 15 mL, 20 mL, 30 mL, 40 mL or 50 mL.

For the treatment of a hyaluronan-associated disease or condition, such as a cancer, the polymer-modified hyaluronan-degrading enzyme can be administered systemically, for example, intravenously (IV), intramuscularly, or by any other systemic route. In particular examples, the lower doses can be given locally. For example, local administration of a hyaluronan-degrading enzyme, such as a PEGylated hyaluronan degrading enzyme for example a PEGylated hyaluronidase (e.g. PH20) includes intratumoral administration, arterial injection (e.g. hepatic artery), intraperitoneal administration, intravesical administration and other local routes used for cancer therapy that can increase local action at a lower absolute dose. In the methods herein for treating a hyaluronan-associated disease or condition, such as a cancer, the enzyme can be administered alone or in combination with therapeutic agents. Further, as provided in other methods herein, corticosteroids can be administered to ameliorate any side effects or adverse events associated with the hyaluronan-degrading enzyme.

In the methods herein of treating a hyaluronan-associated disease or condition, the amounts of a polymer-modified hyaluronan-degrading enzyme as set forth above are administered periodically over a cycle of administration. For example, periodic administration of a polymer-modified hyaluronan-degrading enzyme can be twice weekly, once weekly or once every 21 days. The length of time of the cycle of administration can be empirically determined, and is dependent on the disease to be treated, the severity of the disease, the particular patient, and other considerations within the level of skill of the treating physician. The length of time of treatment with a modified hyaluronidase enzyme can be one week, two weeks, one months, several months, one year, several years or more. For example, a modified hyaluronidase enzyme can be administered twice weekly over a period of a year or more. In some examples, the periodic frequency of administration in subsequent cycles of administration can be reduced. For example, a modified hyaluronidase enzyme can be administered twice weekly for 4 weeks, and then administered once weekly over a period of a year of more. If disease symptoms persist in the absence of discontinued treatment, treatment can be continued for an additional length of time and/or the period of frequency of administration can be increased. Over the course of treatment, evidence of disease and/or treatment-related toxicity or side effects can be monitored. If side effects are observed, a corticosteroid agent can be included in the dosage regime as described herein.

In addition, the cycle of administration can be tailored to add periods of discontinued treatment in order to provide a rest period from exposure to the enzyme. The length of time for the discontinuation of treatment can be for a predetermined time or can be empirically determined depending on how the patient is responding or depending on observed side effects. For example, the treatment can be discontinued for one week, two weeks, one month or several months. Generally, the period of discontinued treatment is built into a cycle of dosing regime for a patient. For example, an exemplary dosing regime is a treatment cycle of 28 days, with the modified enzyme administered for the first 3 weeks, twice weekly, followed by a one week without dosing. Thus, for example, a patient can be dosed with modified enzyme on days 1, 4, 8, 11, 15 and 18, followed by a one-week of discontinued treatment, over the course of the 28-day cycle. As noted above, the cycle of administration can be for any desired length of time. Hence, the 28-day cycle of administration can be repeated for any length of time. It is within the level of skill of the treating physician to adopt a cycle of administration and dosing regime that meets the needs of the patient depending on personal considerations specific to the patient and disease to be treated.

In particular examples, a single dosage administration of a polymer-modified hyaluronan-degrading enzyme, such as a PEGylated hyaluronidase (e.g. PH20), provided herein, for example, PEGPH20, is an amount in a range between or about between 0.5 µg to 1450 µg or 150 Units (U) to 45,000 Units. For example, a single dosage administration is of an amount in a range between or about between 0.75 µg to 1125 µg; 3.75 µg to 750 µg; 56 µg to 565 µg; or 75 µg to 225 µg. In other examples, a single dosage administration is of an amount in a range between or about between 24 Units (U) to 36,000 U; 120 U to 24,000 U; 1500 U to 18,000 U; or 2400 U to 7200 U. For example, provided herein are uses of a hyaluronan-degrading enzyme that is administered to a subject as a unit dosage of an amount in a range between or about between 0.5 µg to 1450 µg or 150 Units (U) to 45,000 Units at a frequency of at least once a week for a cycle of at least 4 weeks. The frequency can be at least twice a week or once a week. It is understood that the cycle of administration for treating a hyaluronan-associated disease or condition can be repeated a plurality of times depending on the particular needs of the patient.

In some examples provided herein, using the methods herein, corticosteroids can be administered in combination with an anti-hyaluronan agent for the treatment or use in treatment of a hyaluronan-associated disease or condition, such as in the treatment of patients with advance solid tumors. In some examples, chemotherapeutic agents or other anti-cancer agents also can be used in the therapy. The therapeutic uses described below are exemplary and do not limit the applications of the methods described herein. It is understood that in the description below, a corticosteroid, such as a glucocorticoid, for example dexamethasone, can be used in combination with an anti-hyaluronan agent in the methods in order to reduce or ameliorate musculoskeletal side effects or other side effects. Dosages and route of administration are described above in Section F.

The provided methods include methods for use of the hyaluronan-degrading enzymes to treat any hyaluronan-associated disease or condition, including, but not limited to, one that is associated with high interstitial fluid pressure, a cancer and in particular a hyaluronan rich cancer, edema, disc pressure, an inflammatory disease, and other diseases associated with hyaluronan. A hyaluronan-associated conditions and diseases are diseases and conditions in which hyaluronan levels are elevated as cause, consequence or otherwise observed in the disease or condition. In some cases, hyaluronan-associated diseases and conditions are associated with increased interstitial fluid pressure, decreased vascular volume, and/or increased water content in a tissue, such as a tumor. Exemplary hyaluronan-associated diseases and conditions that can be treated using the provided enzymes, compositions and methods, include, but are not limited to, hyaluronan-rich cancers, for example, tumors, including solid tumors such as late-stage cancers, a metastatic cancers, undifferentiated cancers, ovarian cancer, in situ carcinoma (ISC), squamous cell carcinoma (SCC), prostate cancer, pancreatic cancer, non-small cell lung cancer, breast cancer, colon cancer and other cancers.

Elevated levels of hyaluronan are associated with numerous inflammatory diseases, including virtually all disease processes involving inflammation. Such diseases and conditions include, but are not limited to, rheumatoid arthritis, periodontitis, scleroderma, psoriasis, atherosclerosis, chronic wounds, Crohn's disease, ulcerative colitis and inflammatory bowel disease. A mechanism for these elevated levels is due to regulation of HA synthase genes by inflammatory mediators, such as IL-1β (Ducale et al. (2005) *Am. J. Physiol. Gatrointest. Liver Physiol.,* 289:G462-G470). In addition, hyaluronan itself is able to interact with and activate various leukocytes, thereby exacerbating the inflammation (see e.g. Ducale et al. 2005; Jiang et al. (2007) *Annu. Rev. Cell. Dev. Biol.,* 23:435-61). Hence, other hyaluronan-associated diseases and conditions that can be treated with anti-hyaluronan agents include inflammatory diseases and conditions, including but not limited to, Rheumatoid arthritis, scleroderma, periodontitis, psoriasis, atherosclerosis, chronic wounds, Crohn's disease, ulcerative colitis and inflammatory bowel disease.

Also exemplary of hyaluronan-associated diseases and conditions are diseases that are associated with elevated interstitial fluid pressure, such as diseases associated with disc pressure, and edema, for example, edema caused by organ transplant, stroke, brain trauma or other injury. Exemplary hyaluronan-associated diseases and conditions include diseases and conditions associated with elevated interstitial fluid pressure, decreased vascular volume, and/or increased water content in a tissue, including cancers, disc pressure and edema. In one example, treatment of the hyaluronan-associated condition, disease or disorder includes amelioration, reduction, or other beneficial effect on one or more of increased interstitial fluid pressure (IFP), decreased vascular volume, and increased water content in a tissue.

Typically, hyaluronan-associated diseases and conditions are associated with elevated hyaluronan expression in a tissue, cell, or body fluid (e.g. tumor tissue or tumor-associated tissue, blood, or interstitial space) compared to a control, e.g. another tissue, cell or body fluid. The elevated hyaluron expression can be elevated compared to a normal tissue, cell or body fluid, for example, a tissue, cell or body fluid that is analogous to the sample being tested, but isolated from a different subject, such as a subject that is normal (i.e. does not have a disease or condition, or does not have the type of disease or condition that the subject being tested has), for example, a subject that does not have a hyaluronan-associated disease or condition. The elevated hyaluronan expression can be elevated compared to an analogous tissue from another subject that has a similar disease or condition, but whose disease is not as severe and/or is not hyaluronan-associated or expresses relatively less hyaluronan and thus is hyaluronan-associated to a lesser degree. For example, the subject being tested can be a subject with a hyaluronan-associated cancer, where the HA amounts in the tissue, cell or fluid are relatively elevated compared to a subject having a less severe cancer, such as an early stage, differentiated or other type of cancer. In another example, the cell, tissue or fluid contains elevated levels of hyaluronan compared to a control sample, such as a fluid, tissue, extract (e.g. cellular or nuclear extract), nucleic acid or peptide preparation, cell line, biopsy, standard or other sample, with a known amount or relative amount of HA, such as a sample, for example a tumor cell line, known to express relatively low levels of HA, such as exemplary tumor cell lines described herein that express low levels of HA, for example, the HCT 116 cell line, the HT29 cell line, the NCI H460 cell line, the DU145 cell line, the Capan-1 cell line, and tumors from tumor models generated using such cell lines (see, e.g. Example 17A).

Typically, the hyaluronan-associated disease or condition is associated with increased HA expression, for example, in a diseased tissue, for example, a tumor. In one example, HALOs (pericellular matrix regions that are rich in proteoglycans, including hyaluronan) form in a tissue of the subject, for example, in a diseased tissue. In another example, the presence of HALOs is detected in an in vitro culture of cells from a tissue of the subject, for example, a diseased tissue.

In one example, the hyaluronan-associated condition, disease or disorder is associated with increased interstitial fluid pressure, decreased vascular volume, or increased water content in a tissue. In one example, treatment of the hyaluronan-associated condition, disease or disorder includes amelioration, reduction, or other beneficial effect on one or more of increased interstitial fluid pressure (IFP), decreased vascular volume, and increased water content in a tissue. The therapeutic uses include treatment of a hyaluronan-associated disease or condition, including cancer treatment, reduction in tumor volume, increased sensitivity to chemotherapy or other cancer treatment, enhancing bioavailability or delivery of a cancer treating or other treating agent, decreasing interstitial fluid pressure, increasing vascular volume, decreasing water content in a tissue in the subject, and other treatments.

1. Selection of Subjects for Treatment and Assessing Treatment Effects

The methods include steps for selecting subjects for treatment with anti-hyaluronan agents and for assessing treatment effects, such as efficacy of treatment. Such methods include methods for detecting hyaluronan-associated disease markers, which include any indication that a subject has a hyaluronan-associated disease, that the subject is likely to respond to treatment by the anti-hyaluronan agent, and/or that a sample from the subject, such as a tissue, cell or fluid, contains elevated hyaluronan expression. Exemplary assays for detecting markers are described below, and include assays for measuring HA expression and/or relative HA expression in a sample from a subject, assays for analyzing effects of anti-hyaluronan agents on a sample from the subject, and assays for measuring readouts typically associated with certain hyaluronan-associated diseases/conditions, such as low hyaluronidase expression or activity, high interstitial fluid pressure, vascular volume and water content. In general, any known assay for detection of proteins or nucleic acids in samples from subjects, or for assessing the effects of treatment on cells/tissues in vitro can be used.

Subjects selected for treatment in the methods provided herein include subjects having elevated, aberrant or accumulated expression of hyaluronan compared to subjects not having the disease or condition or compared to normal tissues or samples that do not have elevated, aberrant or accumulated expression of HA. Any sample or tissue from a subject can be tested and compared to a normal sample or tissue. Hyaluronan levels can be measured from any source such as from a tissue (e.g. by biopsy), tumor, cells, or from blood, serum, urine or other body fluids. For example, as described elsewhere herein, profiles of HA deposition in solid tumors have generally been categorized as pericellular or stromal. Elevated plasma levels of HA have been observed most notably in patients with Wilm's tumor, mesothelioma and liver metastases. Thus, depending on the disease or condition, a different sample can be measured for hyaluronan levels. The choice of sample is within the level of one of skill in the art.

The assay used to measure hyaluronan levels is a function of the disease or condition and can be chosen based on the particular disease or condition. One of skill in the art is familiar with methods of detecting hyaluronan, which include, but are not limited to, immunohistochemistry methods, ELISA methods, as described in section (i) below.

In one example, the step for detecting markers is performed prior to treating a subject, for example, to determine whether the subject has a hyaluronan-associated condition or disease that will be amenable to treatment with an anti-hyaluronan agent. In this example, if the marker is detected (e.g. if it is determined that a cell, tissue or fluid from the patient contains elevated hyaluronan expression or is responsive to hyaluronan degrading enzyme), a treatment step is performed, where a hyaluronan-degrading enzyme is administered to the subject. In one example, when the marker is not detected (e.g. if it is determined that a cell, tissue or fluid from the patient contains normal or non-elevated hyaluronan expression or is not responsive to an anti-hyaluronan agent) another treatment option may be selected.

In another example, the step for detecting markers is performed after treating a subject, or during the course of treatment of the subject, (e.g. treatment with the anti-hyaluronan agent (e.g. soluble modified hyaluronidase) (with or without a co-administered agent), for example, to determine whether the treatment with the anti-hyaluronan agent is having an effect on treating the disease or condition. In one such example, the marker is not detected or is detected at an amount or relative level that is decreased compared to the amount/level prior to treatment, or compared to another sample, treatment is continued, another round of treatment is performed, or another treatment, such as a combination therapy, is initiated. In another such example, if the marker is detected at the same level as prior to treatment or another sample, another treatment option may be selected.

a. Assays for Detection of Hyaluronan-Associated Disease Markers

The assays to detect markers of hyaluronan-associated diseases and conditions include assays to measure amount (e.g. relative amount) of hyaluronan, HA synthase expression and/or hyaluronidase expression in a tissue, cell and/or body fluid of a subject, for example, a tumor. Included amongst such assays are those that can detect HA expression, Hyaluronan synthase 2 (HAS2) expression, the presence of HALOs (pericellular matrix regions that are rich in proteoglycans, including hyaluronan), and the presence of hyaluronan-degrading enzymes, such as hyaluronidases, for example, in samples from the subject.

Assays to detect protein and nucleic acid levels are well known in the art and can be used in the methods herein to measure hyaluronan, hyaluronan synthase or other protein and/or nucleic acid expression. Such assays include, but are not limited to, ELISA, SDS-PAGE, Western Blot, PCR, RT-PCR, immunohistochemistry, histology and flow cytometry. For example, a sample from a subject, such as a tissue sample (e.g. a biopsy of a tumor from a patient or animal model, a stromal sample), a fluid (e.g. blood, urine, plasma, saliva or other sample), a cell or cellular sample, or extract, or other sample, can be stained with anti-HA antibodies, for example, using histological staining, such as immunohistochemistry (IHC) of fixed or frozen tissue sections, to determine the presence and extent of hyaluronan in the tissue or sample, or immunofluorescent cellular staining, pull-down assays, and flow cytometry. In another example, the sample, e.g. biopsy, can be assayed by RT-PCR to assess the amount of HA mRNA.

Known methods for detection of hyaluronan-expression in cancer include, but are not limited to, the ELISA-like assay described in Lokeshwar et al., Cancer Res. 57: 773-777 (1997), for measuring HA levels in urine or bladder tissue extracts of subjects having bladder cancer. For the assay, urine or extracts are coated on microwell plates (umbilical cord HA used as a standard also is coated), followed by incubation (e.g. 16 hours, room temperature) with a labeled (e.g. biotinylated) HA binding protein, such as those described herein, washed and the HA-binding protein bound to the wells quantified using an avidin-biotin detection agent substrate. Such methods are well known in the art. In one example, the urine from a subject with an HA-associated bladder cancer contained HA levels that were elevated 2-9 fold compared to urine/extracts from normal patients (healthy subjects or subjects with other gastrourinary diseases or conditions); thus the marker would be detected if the HA levels in the urine was elevated compared to normal subjects, e.g. elevated from between at or about 2-fold and at or about 9-fold, e.g. at or about 2, 3, 4, 5, 6, 7, 8 or 9-fold elevation compared to normal subject.

In a further example, hyaluronan expression and production in tumor cells in vitro can be assessed using any one of the methods described above. Similarly, Hyaluronan synthase 2 (HAS2) production and/or expression by cells in vitro, ex vivo or in vivo also can be assayed by, for example, ELISA, SDS-PAGE, Western Blot, PCR, RT-PCR, immunohistochemistry, histology or flow cytometry.

In another example, the amount of hyaluronidase activity in a sample from the subject is determined, such as in the blood or plasma, for example, such as with a turbidity assay.

In another example, a cell or other tissue from a patient is isolated, e.g. a tumor cell, and used in a study to determine whether the cell or tissue is responsive to treatment with the hyaluronan degrading enzyme in vitro, for example, using a clonogenic assay or any other assay for measuring growth, proliferation and/or survival of cells or tissues, such as tumor cells, in response to treatment. In one example, cancer cells from a subject are seeded on a surface, such as an extracellular matrix or protein mixture, such as the mixture sold under the trade name Matrigel® (BD Biosciences). In this example, the hyaluronan-associated marker is the sensitivity of the cell or tissue to administration of hyaluronan degrading enzyme. In this example, if any property, such as proliferation, growth or survival of the cells, is inhibited or blocked by addition of hyaluronan degrading enzyme, it is determined that the subject may be amenable to treatment with hyaluronan degrading enzyme containing compositions.

In addition to assays for determining hyaluronan expression levels, other assays can be used to select a subject for treatment, and/or to assess treatment efficacy and/or duration. Interstitial fluid pressure (IFP) can be measured using an appropriate probe or instrument. For example, a transducer-tipped catheter can be used to measure the IFP in cancer tissues or other tissues of interest. The catheter is passed through the inner bore of a surgical needle, which is then inserted into the center of the tumor. The needle is withdrawn while the catheter is held in position. The IEP (mmHg) can then be measured using an appropriate data acquisition unit (see e.g. Ozerdem et al. (2005) Microvasc. Res. 70:116-120). Other methods to measure IFP include the wick-in-needle method (Fadnes et al. (1977) Microvasc. Res. 14:27-36).

Vascular volume can be measured by, for example, by ultrasound imaging. This method employs hyper-echoic microbubbles to provide the strong ultrasound wave reflections that are detected. The microbubbles, when injected, such as intravenously, into a subject or animal model, become trapped in the vascular space due to their size. Assays to assess tissue water content, such as tumor tissue water content, also are known in the art. For example, samples from a tumor can be harvested, blotted, weighed and snap frozen before being lyophilized. The water weight is then reported as the tissue wet weight to dry (i.e. lyophilized) weight ratio.

The ability of a tumor cell to form pericellular matrices (halos) in vitro can be assessed using a particle exclusion assay. Small particles (formalin-fixed red blood cells) can be added to low-density cultures of tumor cells in the presence of, for example, aggrecan, which is a large aggregating chondroitin sulfate proteoglycan. After the particles settle, the cultures can be viewed at 400× magnification to determine whether any halos were formed by the tumor cells. This can are visualized as areas around the cells from which the particles are excluded.

b. Detection of Hyaluronan-Associated Markers Relative to Control Samples

For any of the detection methods, the marker (e.g. HA expression, responsiveness to hyaluronan degrading enzyme, HA-synthase expression or hyaluronidase activity) typically is compared to a control sample, such that detection of the marker typically includes determining that the readout is elevated or reduced compared to the control sample.

For example, the control sample can be another tissue, cell or body fluid, such as a normal tissue, cell or body fluid. For example, a tissue, cell or body fluid that is analogous to the sample being tested, but isolated from a different subject, such as a subject that is normal (i.e. does not have a disease or condition, or does not have the type of disease or condition that the subject being tested has) can be tested. In another example, an analogous tissue from another subject that has a similar disease or condition, but whose disease is not as severe and/or is not hyaluronan-associated or expresses relatively less hyaluronan can be tested. For example, when the cell, tissue or fluid being tested is a subject having a cancer, it can be compared to a tissue, cell or fluid from a subject having a less severe cancer, such as an early stage, differentiated or other type of cancer. In another example, the control sample is a fluid, tissue, extract (e.g. cellular or nuclear extract), nucleic acid or peptide preparation, cell line, biopsy, standard or other sample, with a known amount or relative amount of HA. For example, a sample can include a tumor cell line known to express relatively low levels of HA. Exemplary of such tumor cell lines described herein that express low levels of HA, for example, the HCT 116 cell line, the HT29 cell line, the NCI H460 cell line, the DU145 cell line, the Capan-1 cell line, and tumors from tumor models generated using such cell lines.

It is understood that the particular change, e.g. increase in or decrease in HA, is dependent on the assay used and the source of sample being measured. For example, in an ELISA, the fold increase or decrease in absorbance at a particular wavelength or in quantity of protein (e.g. as determined by using a standard curve) can be expressed relative to a control. In a PCR assay, such as RT-PCR, sample expression levels can be compared to control expression levels (e.g. expressed as fold change) using methods known to those in the art, such as using standards.

For example, when the amount of hyaluronan in a sample from a subject is being tested, detection of the marker can be determining that the amount of HA in the sample (e.g. cancerous cell, tissue or fluid) from the subject is elevated compared to a control sample, such as a control sample described in the previous paragraph. In one example, the cancer is determined to be a hyaluronan-rich cancer if the amount of HA in the tissue, cell or fluid is elevated at or about 0.5-fold, 1-fold, 2-fold, 3-fold, 4-fold, 5-fold, 6-fold, 7-fold, 8-fold, 9-fold, 10-fold, 11-fold, 12-fold, 13-fold, 14-fold, 15-fold, 20-fold, or more, compared to the control sample.

In some examples, a tumor can be directly biopsied and stained for expression of HA. In other examples, a sample, such as a blood or urine sample or other bodily fluid sample associated with the particular tumor can be assayed for HA. The type of assay will vary depending on the tumor-type, although it is contemplated that more than one assay can be used to detect HA. References herein to such assays for particular tumors are for illustration only. For example, for bladder cancers, urine samples can be assayed for hyaluronan by standard ELISA procedures. For purposes herein, subjects that exhibit 1.5-fold, 2-fold, 3-fold, 4-fold, 5-fold, 6-fold, 7-fold, 8-fold, 9-fold, 10-fold or more HA compared to urine from normal patient controls (see e.g., Lokeshwar et al. (2000) J. Urol., 163:348-56), can be selected. In another example, tumor cells can be biopsied and stained for HA, such as by immunohistochemistry (see e.g., Anttila et al. (2000) Cancer Research, 60:150-156; Karvinen et al. (2003) British J of Dermatology, 148:86-94; Lipponen et al. (2001) Euro J Can. 37: 849-856); Auvinen et al. (2000) American J of Pathology, 156:529;). Generally, in such examples, a tumor sample or tumor cell is considered positive for HA if any cancer-cell associated HA signal is observed. As a negative control for background staining, cells can be pre-digested with a hyaluronidase to cleave all cell-associated HA. Samples also can be compared to a normal cell or tissue from the same subject. In addition, in such methods, the level of cell-associated hyaluronan can be scored as low, moderate or high. For example, HA expression is considered high or moderate if 30%, 35%, 40%, 50%, 60%, 70%, 75%, 80%, 85%, 90% or more of the tumoral area showed persistent HA signal. Typically, treatment of subjects with moderate to high HA is contemplated herein.

2. Use in Treating Cancers

As noted above, hyaluronan plays a role in processes associated with cancer and hyaluronan levels correlate with tumor aggressiveness, and various markers for tumor aggressiveness and poor prognosis. Thus, provided are methods for treating hyaluronan-associated cancers with anti-hyaluronan agents in combination with a corticosteroid to ameliorate, reduce or lessen muscoloskeletal side effects induced by the enzyme. The cancers include hyaluronan-rich cancers and cancers that are associated with elevated interstitial fluid pressure.

Hyaluronan plays a role in processes associated with cell motility, including development, regeneration, repair, embryogenesis, embryological development, wound healing, angiogenesis, and tumorigenesis (Toole 1991 Cell Biol. Extracell. Matrix, Hay (ed.), Plenum Press, New York, 1384-1386; Bertrand et al. 1992 Int. J. Cancer 52:1-6; Knudson et al, 1993 FASEB J. 7:1233-1241). In addition, hyaluronan levels correlate with tumor aggressiveness (Ozello et al. 1960 Cancer Res. 20:600-604; Takeuchi et al. 1976, Cancer Res. 36:2133-2139; Kimata et al. 1983 Cancer Res. 43:1347-1354); hyaluronan promotes several cancer processes, including, but not limited to, tumor growth, survival, metastasis and interstitial fluid pressure.

Hyaluronidase has direct anticarcinogenic effects when injected into tumors. Hyaluronidase prevents growth of tumors transplanted into mice (De Maeyer et al., (1992) Int. J. Cancer 51:657-660) and inhibits tumor formation upon exposure to carcinogens (Pawlowski et al. (1979) Int. J. Cancer 23:105-109) Hyaluronidase is effective as the sole therapeutic agent in the treatment of brain cancer (gliomas)

(WO 198802261). As discussed above, other anti-hyaluronan agents also have known anti-tumor activity.

Hyaluronan-associated cancers are cancers associated with hyaluronan-expression, typically elevated hyaluronan expression, which can be determined, for example, prior to treatment, as described above. Exemplary of the hyaluronan-associated diseases and conditions that can be treated using the provided compositions containing an anti-hyaluronan agents and methods are cancers, particularly hyaluronan-rich cancers, for example, hyaluronan-rich cancers that are associated with elevated interstitial fluid pressure.

For example, the hyaluronan-rich cancer can be a cancer in which the cancer cells produce HALOs in an in vitro particle exclusion assay; cancers that have elevated expression of hyaluronan (as determined by immunostaining, e.g. histological staining of sections from the tumor); cancers that have elevated HAS2 (Hyaluronan synthase 2); and cancers that do not produce hyaluronidase (HYAL1) in vitro. Hyaluronan-rich cancers can be identified by any method for assessing hyaluronan expression as described herein, and other known methods for assaying protein/mRNA expression.

Several hyaluronan-rich cancers have been identified. In some cases, hyaluronan expression correlates with poor prognosis, for example, decreased survival rate and/or recurrence-free survival rate, metastases, angiogenesis, cancer cell invasion into other tissues/areas, and other indicators of poor prognosis. Such correlation has been observed, for example, in hyaluronan-rich tumors including ovarian cancer, SCC, ISC, prostate cancer, lung cancer, including non-small-cell lung cancer (NSCLC), breast cancer, colon cancer and pancreatic cancer (see, for example, Maarit et al., *Cancer Research,* 60:150-155 (2000); Karvinen et al., *British Journal of Dermatology,* 148:86-94 (2003); Lipponen et al., *Eur. Journal of Cancer,* 849-856 (2001); Pirinen et al., *Int. J. Cancer:* 95: 12-17 (2001); Auvinen et al., *American Journal of Pathology,* 156(2):529-536 (2000); Ropponen et al., *Cancer Research,* 58: 342-347 (1998)). Thus, hyaluronan-rich cancers can be treated by administration of an anti-hyaluronan agent, such as a hyaluronidase, to treat one or more symptoms of the cancer. Hyaluronan-rich tumors include, but are not limited to, prostate, breast, colon, ovarian, stomach, head and neck and other tumors and cancers.

Anti-hyaluronan agents, such as hyaluronan degrading enzymes, including hyaluronidases, can also be used to increase the sensitivity of tumors that are resistant to conventional chemotherapy. For example, anti-hyaluronan agents, for example a hyaluronan degrading enzymes, including hyaluronidases, such as rHuPH20, can be administered to a patient having a tumor associated with a HYAL1 defect in an amount effective to increase diffusion around the tumor site (e.g., to facilitate circulation and/or concentrations of chemotherapeutic agents in and around the tumor site), inhibit tumor cell motility, such as by hyaluronic acid degradation, and/or to lower the tumor cell apoptosis threshold. This can bring the tumor cell(s) to a state of anoikis, which renders the tumor cell more susceptible to the action of chemotherapeutic agents. Administration of an anti-hyaluronan agent, such as a hyaluronidase, can induce responsiveness of previously chemotherapy-resistant tumors of the pancreas, stomach, colon, ovaries, and breast (Baumgartner et al. (1988) Reg. Cancer Treat. 1:55-58; Zanker et al. (1986) Proc. Amer. Assoc. Cancer Res. 27:390).

In one example, anti-hyaluronan agents, such as hyaluronan degrading enzymes, in particular, hyaluronidases, are used in the treatment of metastatic and non-metastatic cancers, including those that have decreased endogenous hyaluronidase activity relative to non-cancerous cells. Anti-hyaluronan agents, for example hyaluronan degrading enzymes such as hyaluronidases, can be used as a chemotherapeutic agent alone or in combination with other chemotherapeutics. Exemplary cancers include, but are not limited to, small lung cell carcinoma, squamous lung cell carcinoma, and cancers of the breast, ovaries, head and neck, or any other cancer associated with depressed levels of hyaluronidase activity or decreased hyaluronic acid catabolism.

In addition to treatment of the disease with the anti-hyaluronan agent alone (and also in combination with a corticosteroid), the compositions and methods provided herein also can be used to treat hyaluronan-associated cancers by administration of the anti-hyaluronan agent in combination with, for example, simultaneously or prior to, a chemotherapeutic or other anti-cancer agent or treatment. In this example, the anti-hyaluronan agent, for example a hyaluronan degrading enzyme, such as a hyaluronidase, typically enhances penetration of chemotherapeutic or other anti-cancer agents into solid tumors, thereby treating the disease. The anti-hyaluronan agent, for example a hyaluronan degrading enzyme, such as a hyaluronidase, can be injected intratumorally with anti-cancer agents or intravenously for disseminated cancers or hard to reach tumors.

The anticancer agent can be a chemotherapeutic, an antibody, a peptide, or a gene therapy vector, virus or DNA. Additionally, an anti-hyaluronan agent, for example a hyaluronan degrading enzymes, such as a hyaluronidase, can be used to recruit tumor cells into the cycling pool for sensitization in previously chemorefractory tumors that have acquired multiple drug resistance (St Croix et al., (1998) Cancer Lett September 131(1): 35-44). Anti-hyaluronan agents, such as hyaluronan degrading enzymes, including hyaluronidases, such as, for example, rHuPH20, also can enhance delivery of biologics such as monoclonal antibodies, cytokines and other drugs to tumors that accumulate glycosaminoglycans.

Exemplary anti-cancer agents that can be administered after, coincident with or before administration of an anti-hyaluronan agent, for example a hyaluronan degrading enzyme, such as a hyaluronidase, include, but are not limited to Acivicins; Aclarubicins; Acodazoles; Acronines; Adozelesins; Aldesleukins; Alemtuzumabs; Alitretinoins (9-Cis-Retinoic Acids); Allopurinols; Altretamines; Alvocidibs; Ambazones; Ambomycins; Ametantrones; Amifostines; Aminoglutethimides; Amsacrines; Anastrozoles; Anaxirones; Ancitabines; Anthramycins; Apaziquones; Argimesnas; Arsenic Trioxides; Asparaginases; Asperlins; Atrimustines; Azacitidines; Azetepas; Azotomycins; Banoxantrones; Batabulins; Batimastats; BCG Live; Benaxibines; Bendamustines; Benzodepas; Bexarotenes; Bevacizumab; Bicalutamides; Bietaserpines; Biricodars; Bisantrenes; Bisantrenes; Bisnafide Dimesylates; Bizelesins; Bleomycins; Bortezomibs; Brequinars; Bropirimines; Budotitanes; Busulfans; Cactinomycins; Calusterones; Canertinibs; Capecitabines; Caracemides; Carbetimers; Carboplatins; Carboquones; Carmofurs; Carmustines with Polifeprosans; Carmustines; Carubicins; Carzelesins; Cedefingols; Celecoxibs; Cemadotins; Chlorambucils; Cioteronels; Cirolemycins; Cisplatins; Cladribines; Clanfenurs; Clofarabines; Crisnatols; Cyclophosphamides; Cytarabine liposomals; Cytarabines; Dacarbazines; Dactinomycins; Darbepoetin Alfas; Daunorubicin liposomals; Daunorubicins/Daunomycins; Daunorubicins; Decitabines; Denileukin Diftitoxes; Dexniguldipines; Dexonnaplatins; Dexrazoxanes; Dezaguanines; Diaziquones; Dibrospidiums; Dienogests; Dinalins; Disermolides; Docetaxels; Dofequidars; Doxifluridines; Doxorubicin liposomals; Doxorubicin HCL; Doxorubicin HCL liposome injection; Doxorubicins; Droloxifenes; Dromostanolone Propionates; Duazomycins; Ecomustines; Edatrexates; Edotecarins; Eflornithines; Elacridars; Elinafides; Elliott's B Solutions; Elsamitrucins; Emitefurs; Enloplatins; Enpromates; Enzastaurins; Epipropidines; Epirubicins; Epoetin alfas; Eptaloprosts; Erbulozoles; Esorubicins; Estramustines; Etanidazoles; Etoglucids; Etoposide phosphates; Etoposide VP-16s; Etoposides; Etoprines; Exemestanes; Exisulinds; Fadrozoles; Fazarabines; Fenretinides; Filgrastims; Floxuridines; Fludarabines; Fluorouracils; 5-fluorouracils; Fluoxymesterones; Fluorocitabines; Fosquidones; Fostriecins; Fostriecins; Fotretamines; Fulvestrants; Galarubicins; Galocitabines; Gemcitabines; Gemtuzumabs/Ozogamicins; Geroquinols; Gimatecans; Gimeracils; Gloxazones; Glufosfamides; Goserelin acetates; Hydroxyureas; Ibritumomabs/Tiuxetans; Idarubicins; Ifosfamides; Ilmofosines; Ilomastats; Imatinib mesylates; Imexons; Improsulfans; Indisulams; Inproquones; Interferon alfa-2 as; Interferon alfa-2bs; Interferon Alfas; Interferon Betas; Interferon Gammas; Interferons; Interleukin-2s and other Interleukins (including recombinant Interleukins); Intoplicines; Iobenguanes [131-I]; Iproplatins; Irinotecans; Irsogladines; Ixabepilones; Ketotrexates; L-Alanosines; Lanreotides; Lapatinibs; Ledoxantrones; Letrozoles; Leucovorins; Leuprolides; Leuprorelins (Leuprorelides); Levamisoles; Lexacalcitols; Liarozoles; Lobaplatins; Lometrexols; Lomustines/CCNUs; Lomustines; Lonafarnibs; Losoxantrones; Lurtotecans; Mafosfamides; Mannosulfans; Marimastats; Masoprocols; Maytansines; Mechlorethamines; Mechlorethamines/Nitrogen mustards; Megestrol acetates; Megestrols; Melengestrols; Melphalans; MelphalansIL-PAMs; Menogarils; Mepitiostanes; Mercaptopurines; 6-Mercaptopurine; Mesnas; Metesinds; Methotrexates; Methoxsalens; Metomidates; Metoprines; Meturedepas; Miboplatins; Miproxifenes; Misonidazoles; Mitindomides; Mitocarcins; Mitocromins; Mitoflaxones; Mitogillins; Mitoguazones; Mitomalcins; Mitomycin Cs; Mitomycins; Mitonafides; Mitoquidones; Mitospers; Mitotanes; Mitoxantrones; Mitozolomides; Mivobulins; Mizoribines; Mofarotenes; Mopidamols; Mubritinibs; Mycophenolic Acids; Nandrolone Phenpropionates; Nedaplatins; Nelzarabines; Nemorubicins; Nitracrines; Nocodazoles; Nofetumomabs; Nogalamycins; Nolatrexeds; Nortopixantrones; Octreotides; Oprelvekins; Ormaplatins; Ortataxels; Oteracils; Oxaliplatins; Oxisurans; Oxophenarsines; Paclitaxels; Pamidronates; Patubilones; Pegademases; Pegaspargases; Pegfilgrastims; Peldesines; Peliomycins; Pelitrexols; Pemetrexeds; Pentamustines; Pentostatins; Peplomycins; Perfosfamides; Perifosines; Picoplatins; Pinafides; Pipobromans; Piposulfans; Pirfenidones; Piroxantrones; Pixantrones; Plevitrexeds; Plicamycid Mithramycins; Plicamycins; Plomestanes; Plomestanes; Porfimer sodiums; Porfimers; Porfiromycins; Prednimustines; Procarbazines; Propamidines; Prospidiums; Pumitepas; Puromycins; Pyrazofurins; Quinacrines; Ranimustines; Rasburicases; Riboprines; Ritrosulfans; Rituximabs; Rogletimides; Roquinimexs; Rufocromomycins; Sabarubicins; Safingols; Sargramostims; Satraplatins; Sebriplatins; Semustines; Simtrazenes; Sizofurans; Sobuzoxanes; Sorafenibs; Sparfosates; Sparfosic Acids; Sparsomycins; Spirogermaniums; Spiromustines; Spiroplatins; Spiroplatins; Squalamines; Streptonigrins; Streptovarycins; Streptozocins; Sufosfamides; Sulofenurs; Sunitinib Malate; 6-thioguanine (6-TG); Tacedinalines; Talcs; Talismycins; Tallimustines; Tamoxifens; Tariquidars; Tauromustines; Tecogalans; Tegafurs; Teloxantrones; Temoporfins; Temozolomides; Teniposides/VM-26s; Teniposides; Teroxirones; Testolactones; Thiamiprines; Thioguanines; Thiotepas; Tiamiprines; Tiazofurins; Tilomisoles; Tilorones; Timcodars; Timonacics; Tirapazamines; Topixantrones; Topotecans; Toremifenes; Tositumomabs; Trabectedins (Ecteinascidin 743); Trastuzumabs; Trestolones; Tretinoins/ATRA; Triciribines; Trilostanes; Trimetrexates; Triplatin Tetranitrates; Triptorelins; Trofosfamides; Tubulozoles; Ubenimexs; Uracil Mustards; Uredepas; Valrubicins; Valspodars; Vapreotides; Verteporfins; Vinblastines; Vincristines; Vindesines; Vinepidines; Vinflunines; Vinformides; Vinglycinates; Vinleucinols; Vinleurosines; Vinorelbines; Vinrosidines; Vintriptols; Vinzolidines; Vorozoles; Xanthomycin As (Guamecyclines); Zeniplatins; Zilascorbs [2-H]; Zinostatins; Zoledronate; Zorubicins; and Zosuquidars, for example:

Aldesleukins (e.g. PROLEUKIN®); Alemtuzumabs (e.g. CAMPATH®); Alitretinoins (e.g. PANRETIN®); Allopurinols (e.g. ZYLOPRIM®); Altretamines (e.g. HEXALEN®); Amifostines (e.g. ETHYOL®); Anastrozoles (e.g. ARIMIDEX®); Arsenic Trioxides (e.g. TRISENOX®); Asparaginases (e.g. ELSPAR®); BCG Live (e.g. TICE® BCG); Bexarotenes (e.g. TARGRETIN®); Bevacizumab (AVASTIN®); Bleomycins (e.g. BLENOXANE®); Busulfan intravenous (e.g. BUSULFEX®); Busulfan orals (e.g. MYLERAN®); Calusterones (e.g. METHOSARB®); Capecitabines (e.g. XELODA®); Carboplatins (e.g. PARAPLATIN®); Carmustines (e.g. BCNU®, BiCNU®); Carmustines with Polifeprosans (e.g. GLIADEL® Wafer); Celecoxibs (e.g. CELEBREX®); Chlorambucils (e.g. LEUKERAN®); Cisplatins (e.g. PLATINOL®); Cladribines (e.g. LEUSTATIN®, 2-CdA®); Cyclophosphamides (e.g. CYTOXAN®, NEOSAR®); Cytarabines (e.g. CYTOSAR-U®); Cytarabine liposomals (e.g. DepoCyt®); Dacarbazines (e.g. DTIC-Dome): Dactinomycins (e.g. COSMEGEN®); Darbepoetin Alfas (e.g. ARANESP®); Daunorubicin liposomals (e.g. DANUOXOME®); Daunorubicins/Daunomycins (e.g. CERUBIDINE®); Denileukin Diftitoxes (e.g. ONTAK®); Dexrazoxanes (e.g. ZINECARD®); Docetaxels (e.g. TAXOTERE®); Doxorubicins (e.g. ADRIAMYCIN®, RUBEX®); Doxorubicin liposomals, including Doxorubicin HCL liposome injections (e.g. DOXIL®); Dromostanolone propionates (e.g. DROMOSTANOLONE® and MASTERONE® Injection); Elliott's B Solutions (e.g. Elliott's B Solution®); Epirubicins (e.g. ELLENCE®); Epoetin alfas (e.g. EPOGEN®); Estramustines (e.g. EMCYT®); Etoposide phosphates (e.g. ETOPOPHOS®); Etoposide VP-16s (e.g. VEPESID®); Exemestanes (e.g. AROMASIN®); Filgrastims (e.g. NEUPOGEN®); Floxuridines (e.g. FUDR®); Fludarabines (e.g. FLUDARA®); Fluorouracils incl. 5-FUs (e.g. ADRUCIL®); Fulvestrants (e.g. FASLODEX®); Gemcitabines (e.g. GEMZAR®); Gemtuzumabs/Ozogamicins (e.g. MYLOTARG®); Goserelin acetates (e.g. ZOLADEX®); Hydroxyureas (e.g. HYDREA®); Ibritumomabs/Tiuxetans (e.g. ZEVALIN®); Idarubicins (e.g. IDAMYCIN®); Ifosfamides (e.g. IFEX®); Imatinib mesylates (e.g. GLEEVEC®); Interferon alfa-2 as (e.g. ROFERON-A®); Interferon alfa-2bs (e.g. INTRON A®); Irinotecans (e.g. CAMPTOSAR®); Letrozoles (e.g. FEMARA®); Leucovorins (e.g. WELLCOVORIN®, LEUCOVORIN®); Levamisoles (e.g. ERGAMISOL®); Lomustines/CCNUs (e.g. CeeBU®); Mechlorethamines/Nitrogen mustards (e.g. MUSTARGEN®); Megestrol acetates (e.g. MEGACE®); Melphalans/L-PAMs (e.g. ALKERAN®); Mercaptopurine, including 6-mercaptopurines (6-MPs; e.g. PURINETHOL®); Mesnas (e.g. MESNEX®); Methotrexates; Methoxsalens (e.g. UVADEX®); Mitomycin Cs (e.g. MUTAMYCIN®, MITOZYTREX®); Mitotanes (e.g. LYSODREN®); Mitoxantrones (e.g. NOVANTRONE®); Nandrolone Phenpropionates (e.g. DURABOLIN-50®); Nofetumomabs (e.g. VERLUMA®); Oprelvekins (e.g. NEUMEGA®); Oxaliplatins (e.g. ELOXATIN®); Paclitaxels (e.g. PAXENE®, TAXOL®); Pamidronates (e.g. AREDIA®); Pegademases (e.g. ADAGEN®); Pegaspargases (e.g. ONCASPAR®); Pegfilgrastims (e.g. NEULASTA®); Pentostatins (e.g. NIPENT®); Pipobromans (e.g. VERCYTE®); Plicamycin/Mithramycins (e.g. MITHRACIN®); Porfimer sodiums (e.g. PHOTOFRIN®); Procarbazines (e.g. MATULANE®); Quinacrines (e.g. ATABRINE®); Rasburicases (e.g. ELITEK®); Rituximabs (e.g. RITUXAN®); Sargramostims (e.g. PROKINE®); Streptozocins (e.g. ZANOSAR®); Sunitinib Malates (e.g. SUTENT®); Talcs (e.g. SCLEROSOL®); Tamoxifens (e.g. NOLVADEX®); Temozolomides (e.g. TEMODAR®); Teniposides/VM-26s (e.g. VUMON®); Testolactones (e.g. TESLAC®); Thioguanines including, 6-thioguanine (6-TG); Thiotepas (e.g. THIOPLEX®); Topotecans (e.g. HYCAMTIN®); Toremifenes (e.g. FARESTON®); Tositumomabs (e.g. BEXXAR®); Trastuzumabs (e.g. HERCEPTIN®); Tretinoins/ATRA (e.g. VESANOID®); Uracil Mustards; Valrubicins (e.g. VALSTAR®); Vinblastines (e.g. VELBAN®); Vincristines (e.g. ONCOVIN®); Vinorelbines (e.g. NAVELBINE®); and Zoledronates (e.g. ZOMETA®).

In one example, an anti-hyaluronan agent, for example a hyaluronan degrading enzyme, such as a modified hyaluronidase, for example, PEGylated rHuPH20, is administered to a subject after, coincident with or before administration of one or more of docetaxel (e.g. TAXOTERE®), Doxorubicin liposomal (e.g. DOXIL®), Sunitinib Malate (e.g. SUTENT®) or Bevacizumab (AVASTIN®). In the methods herein, a corticosteroid also is administered to ameliorate or prevent side effects, such as musculoskeletal side effects resulting from or associated with administration of the anti-hyaluronan agent.

I. Examples

The following examples are included for illustrative purposes only and are not intended to limit the scope of the invention.

Example 1 rHuPH20 Expressing Cell Lines

A. Generation of an Initial Soluble rHuPH20-Expressing Cell Line

Chinese Hamster Ovary (CHO) cells were transfected with the HZ24 plasmid (set forth in SEQ ID NO:52). The HZ24 plasmid vector for expression of soluble rHuPH20 contains a pCI vector backbone (Promega), DNA encoding amino acids 1-482 of human PH20 hyaluronidase (SEQ ID NO:49), an internal ribosomal entry site (IRES) from the ECMV virus (Clontech), and the mouse dihydrofolate reductase (DHFR) gene. The pCI vector backbone also includes DNA encoding the Beta-lactamase resistance gene (AmpR), an f1 origin of replication, a Cytomegalovirus immediate-early enhancer/promoter region (CMV), a chimeric intron, and an SV40 late polyadenylation signal (SV40). The DNA encoding the soluble rHuPH20 construct contains an NheI site and a Kozak consensus sequence prior to the DNA encoding the methionine at amino acid position 1 of the native 35 amino acid signal sequence of human PH20, and a stop codon following the DNA encoding the tyrosine corresponding to amino acid position 482 of the human PH20 hyaluronidase set forth in SEQ ID NO:1), followed by a BamHI restriction site. The construct pCI-PH20-IRES-DHFR-SV40pa (HZ24), therefore, results in a single mRNA species driven by the CMV promoter that encodes amino acids 1-482 of human PH20 (set forth in SEQ ID NO:3) and amino acids 1-186 of mouse dihydrofolate reductase (set forth in SEQ ID NO:53), separated by the internal ribosomal entry site (IRES).

Non-transfected CHO cells growing in GIBCO Modified CD-CHO media for DHFR(−) cells, supplemented with 4 mM Glutamine and 18 ml/L Plurionic F68/L (Gibco), were seeded at $0.5 \times 10^6$ cells/ml in a shaker flask in preparation for transfection. Cells were grown at 37° C. in 5% $CO_2$ in a humidified incubator, shaking at 120 rpm. Exponentially growing non-transfected CHO cells were tested for viability prior to transfection.

Sixty million viable cells of the non-transfected CHO cell culture were pelleted and resuspended to a density of $2 \times 10^7$ cells in 0.7 mL of 2× transfection buffer (2×HeBS: 40 mM Hepes, pH 7.0, 274 mM NaCl, 10 mM KCl, 1.4 mM $Na_2HPO_4$, 12 mM dextrose). To each aliquot of resuspended cells, 0.09 mL (250 µg) of the linear HZ24 plasmid (linearized by overnight digestion with Cla I (New England Biolabs) was added, and the cell/DNA solutions were transferred into 0.4 cm gap BTX (Gentronics) electroporation cuvettes at room temperature. A negative control electroporation was performed with no plasmid DNA mixed with the cells. The cell/plasmid mixes were electroporated with a capacitor discharge of 330 V and 960 µF or at 350 V and 960 µF.

The cells were removed from the cuvettes after electroporation and transferred into 5 mL of Modified CD-CHO media for DHFR(−) cells, supplemented with 4 mM Glutamine and 18 ml/L Plurionic F68/L (Gibco), and allowed to grow in a well of a 6-well tissue culture plate without selection for 2 days at 37° C. in 5% $CO_2$ in a humidified incubator.

Two days post-electroporation, 0.5 mL of tissue culture media was removed from each well and tested for the presence of hyaluronidase activity using the microturbidity assay described in Example 4. Cells expressing the highest levels of hyaluronidase activity were collected from the tissue culture well, counted and diluted to $1 \times 10^4$ to $2 \times 10^4$ viable cells per mL. A 0.1 mL aliquot of the cell suspension was transferred to each well of five, 96 well round bottom tissue culture plates. One hundred microliters of CD-CHO media (GIBCO) containing 4 mM GlutaMAX™-1 supplement (GIBCO™, Invitrogen Corporation) and without hypoxanthine and thymidine supplements were added to the wells containing cells (final volume 0.2 mL).

Ten clones were identified from the 5 plates grown without methotrexate. Six of these HZ24 clones were expanded in culture and transferred into shaker flasks as single cell suspensions. Clones 3D3, 3E5, 2G8, 2D9, 1E11, and 4D10 were plated into 96-well round bottom tissue culture plates using a two-dimensional infinite dilution strategy in which cells were diluted 1:2 down the plate, and 1:3 across the plate, starting at 5000 cells in the top left hand well. Diluted clones were grown in a background of 500 non-transfected DG44 CHO cells per well, to provide necessary growth factors for the initial days in culture. Ten plates were made per subclone, with 5 plates containing 50 nM methotrexate and 5 plates without methotrexate.

Clone 3D3 produced 24 visual subclones (13 from the no methotrexate treatment, and 11 from the 50 nM methotrexate treatment). Significant hyaluronidase activity was measured in the supernatants from 8 of the 24 subclones (>50 Units/mL), and these 8 subclones were expanded into T-25 tissue culture flasks. Clones isolated from the methotrexate treatment protocol were expanded in the presence of 50 nM methotrexate. Clone 3D35M was further expanded in 500 nM methotrexate in shaker flasks and gave rise to clones producing in excess of 1,000 Units/ml hyaluronidase activity (clone 3D35M; or Gen1 3D35M). A master cell bank (MCB) of the 3D35M cells was then prepared B. Generation of a Second Generation Cell Line Expressing Soluble rHuPH20

The Gen1 3D35M cell line described in Example 1A was adapted to higher methotrexate levels to produce generation 2 (Gen2) clones. 3D35M cells were seeded from established methotrexate-containing cultures into CD CHO medium containing 4 mM GlutaMAX-1™ and 1.0 µM methotrexate. The cells were adapted to a higher methotrexate level by growing and passaging them 9 times over a period of 46 days in a 37° C., 7% $CO_2$ humidified incubator. The amplified population of cells was cloned out by limiting dilution in 96-well tissue culture plates containing medium with 2.0 µM methotrexate. After approximately 4 weeks, clones were identified and clone 3E10B was selected for expansion. 3E10B cells were grown in CD CHO medium containing 4 mM GlutaMAX-1™ and 2.0 µM methotrexate for 20 passages. A master cell bank (MCB) of the 3E10B cell line was created and frozen and used for subsequent studies.

Amplification of the cell line continued by culturing 3E10B cells in CD CHO medium containing 4 mM GlutaMAX-1™ and 4.0 µM methotrexate. After the $12^{th}$ passage, cells were frozen in vials as a research cell bank (RCB). One vial of the RCB was thawed and cultured in medium containing 8.0 µM methotrexate. After 5 days, the methotrexate concentration in the medium was increased to 16.0 µM, then 20.0 µM 18 days later. Cells from the $8^{th}$ passage in medium containing 20.0 µM methotrexate were cloned out by limiting dilution in 96-well tissue culture plates containing CD CHO medium containing 4 mM GlutaMAX-1™ and 20.0 µM methotrexate. Clones were identified 5-6 weeks later and clone 2B2 was selected for expansion in medium containing 20.0 µM methotrexate. After the 11th passage, 2B2 cells were frozen in vials as a research cell bank (RCB).

The resultant 2B2 cells are dihydrofolate reductase deficient (dhfr−) DG44 CHO cells that express soluble recombinant human PH20 (rHuPH20). The soluble PH20 is present in 2B2 cells at a copy number of approximately 206 copies/cell. Southern blot analysis of Spe I-, Xba I- and BamH I/Hind III-digested genomic 2B2 cell DNA using a rHuPH20-specific probe revealed the following restriction digest profile: one major hybridizing band of ~7.7 kb and four minor hybridizing bands (~13.9, ~6.6, ~5.7 and ~4.6 kb) with DNA digested with Spe I; one major hybridizing band of ~5.0 kb and two minor hybridizing bands (~13.9 and ~6.5 kb) with DNA digested with Xba I; and one single hybridizing band of ~1.4 kb observed using 2B2 DNA digested with BamH I/Hind III. Sequence analysis of the mRNA transcript indicated that the derived cDNA (SEQ ID NO:56) was identical to the reference sequence (SEQ ID NO:49) except for one base pair difference at position 1131, which was observed to be a thymidine (T) instead of the expected cytosine (C). This is a silent mutation, with no effect on the amino acid sequence.

Example 2

Production and Purification of rHuPH20

A. Production of Gen2 soluble rHuPH20 in 300 L Bioreactor Cell Culture

A vial of HZ24-2B2 cells (Example 1B) was thawed and expanded from shaker flasks through 36 L spinner flasks in CD-CHO media (Invitrogen, Carlsbad, Calif.) supplemented with 20 µM methotrexate and GlutaMAX-1™ (Invitrogen). Briefly, a vial of cells was thawed in a 37° C. water bath, media was added and the cells were centrifuged. The cells were re-suspended in a 125 mL shake flask with 20 mL of fresh media and placed in a 37° C., 7% $CO_2$ incubator. The cells were expanded up to 40 mL in the 125 mL shake flask. When the cell density reached greater than $1.5 \times 10^6$ cells/mL, the culture was expanded into a 125 mL spinner flask in a 100 mL culture volume. The flask was incubated at 37° C., 7% $CO_2$. When the cell density reached greater than $1.5 \times 10^6$ cells/mL, the culture was expanded into a 250 mL spinner flask in 200 mL culture volume, and the flask was incubated at 37° C., 7% $CO_2$. When the cell density reached greater than $1.5 \times 10^6$ cells/mL, the culture was expanded into a 1 L spinner flask in 800 mL culture volume and incubated at 37° C., 7% $CO_2$. When the cell density reached greater than $1.5 \times 10^6$ cells/mL the culture was expanded into a 6 L spinner flask in 5000 mL culture volume and incubated at 37° C., 7% $CO_2$. When the cell density reached greater than $1.5 \times 10^6$ cells/mL the culture was expanded into a 36 L spinner flask in 32 L culture volume and incubated at 37° C., 7% $CO_2$.

A 400 L reactor was sterilized and 230 mL of CD-CHO media was added. Before use, the reactor was checked for contamination. Approximately 30 L cells were transferred from the 36 L spinner flasks to the 400 L bioreactor (Braun) at an inoculation density of $4.0 \times 10^5$ viable cells per ml and a total volume of 260 L. Parameters were temperature set point, 37° C.; Impeller Speed 40-55 RPM; Vessel Pressure: 3 psi; Air Sparge 0.5-1.5 L/Min.; Air Overlay: 3 L/min. The reactor was sampled daily for cell counts, pH verification, media analysis, protein production and retention. Also, during the run nutrient feeds were added. At 120 hrs (day 5), 10.4 L of Feed #1 Medium (4×CD-CHO+33 g/L Glucose+160 mL/L Glutamax-1™+83 mL/L Yeastolate+33 mg/L rHuInsulin) was added. At 168 hours (day 7), 10.8 L of Feed #2 (2×CD-CHO+33 g/L Glucose+80 mL/L Glutamax-1™+167 mL/L Yeastolate+0.92 g/L Sodium Butyrate) was added, and culture temperature was changed to 36.5° C. At 216 hours (day 9), 10.8 L of Feed #3 (1×CD-CHO+50 g/L Glucose+50 mL/L Glutamax-1™+250 mL/L Yeastolate+1.80 g/L Sodium Butyrate) was added, and culture temperature was changed to 36° C. At 264 hours (day 11), 10.8 L of Feed #4 (1×CD-CHO+33 g/L Glucose+33 mL/L Glutamax-1™+250 mL/L Yeastolate+0.92 g/L Sodium Butyrate) was added, and culture temperature was changed to 35.5° C. The addition of the feed media was observed to dramatically enhance the production of soluble rHuPH20 in the final stages of production. The reactor was harvested at 14 or 15 days or when the viability of the cells dropped below 40%. The process resulted in a final productivity of 17,000 Units per ml with a maximal cell density of 12 million cells/mL. At harvest, the culture was sampled for mycoplasma, bioburden, endotoxin and viral in vitro and in vivo, Transmission Electron Microscopy (TEM) and enzyme activity.

The culture was pumped by a peristaltic pump through four Millistak filtration system modules (Millipore) in parallel, each containing a layer of diatomaceous earth graded to 4-8 μm and a layer of diatomaceous earth graded to 1.4-1.1 μm, followed by a cellulose membrane, then through a second single Millistak filtration system (Millipore) containing a layer of diatomaceous earth graded to 0.4-0.11 μm and a layer of diatomaceous earth graded to <0.1 μm, followed by a cellulose membrane, and then through a 0.22 μm final filter into a sterile single use flexible bag with a 350 L capacity. The harvested cell culture fluid was supplemented with 10 mM EDTA and 10 mM Tris to a pH of 7.5. The culture was concentrated 10× with a tangential flow filtration (TFF) apparatus using four Sartoslice TFF 30 kDa molecular weight cut-off (MWCO) polyether sulfone (PES) filters (Sartorius), followed by a 10× buffer exchange with 10 mM Tris, 20 mM $Na_2SO_4$, pH 7.5 into a 0.22 μm final filter into a 50 L sterile storage bag.

The concentrated, diafiltered harvest was inactivated for virus. Prior to viral inactivation, a solution of 10% Triton X-100, 3% tri (n-butyl) phosphate (TNBP) was prepared. The concentrated, diafiltered harvest was exposed to 1% Triton X-100, 0.3% TNBP for 1 hour in a 36 L glass reaction vessel immediately prior to purification on the Q column.

B. Purification of Gen2 Soluble rHuPH20

A Q Sepharose (Pharmacia) ion exchange column (9 L resin, H=29 cm, D=20 cm) was prepared. Wash samples were collected for a determination of pH, conductivity and endotoxin (LAL) assay. The column was equilibrated with 5 column volumes of 10 mM Tris, 20 mM Na2SO4, pH 7.5. Following viral inactivation, the concentrated, diafiltered harvest (Example 2A) was loaded onto the Q column at a flow rate of 100 cm/hr. The column was washed with 5 column volumes of 10 mM Tris, 20 mM Na2SO4, pH 7.5 and 10 mM Hepes, 50 mM NaCl, pH 7.0. The protein was eluted with 10 mM Hepes, 400 mM NaCl, pH 7.0 into a 0.22 μm final filter into a sterile bag. The eluate sample was tested for bioburden, protein concentration and hyaluronidase activity. $A_{280}$ absorbance readings were taken at the beginning and end of the exchange.

Phenyl-Sepharose (Pharmacia) hydrophobic interaction chromatography was next performed. A Phenyl-Sepharose (PS) column (19-21 L resin, H=29 cm, D=30 cm) was prepared. The wash was collected and sampled for pH, conductivity and endotoxin (LAL) assay. The column was equilibrated with 5 column volumes of 5 mM potassium phosphate, 0.5 M ammonium sulfate, 0.1 mM $CaCl_2$, pH 7.0. The protein eluate from the Q sepharose column was supplemented with 2M ammonium sulfate, 1 M potassium phosphate and 1 M $CaCl_2$ stock solutions to yield final concentrations of 5 mM, 0.5 M and 0.1 mM, respectively. The protein was loaded onto the PS column at a flow rate of 100 cm/hr and the column flow thru collected. The column was washed with 5 mM potassium phosphate, 0.5 M ammonium sulfate and 0.1 mM $CaCl_2$ pH 7.0 at 100 cm/hr and the wash was added to the collected flow thru. Combined with the column wash, the flow through was passed through a 0.22 μm final filter into a sterile bag. The flow through was sampled for bioburden, protein concentration and enzyme activity.

An aminophenyl boronate column (ProMedics) was prepared. The wash was collected and sampled for pH, conductivity and endotoxin (LAL) assay. The column was equilibrated with 5 column volumes of 5 mM potassium phosphate, 0.5 M ammonium sulfate. The PS flow through containing purified protein was loaded onto the aminophenyl boronate column at a flow rate of 100 cm/hr. The column was washed with 5 mM potassium phosphate, 0.5 M ammonium sulfate, pH 7.0. The column was washed with 20 mM bicine, 0.5 M ammonium sulfate, pH 9.0. The column was washed with 20 mM bicine, 100 mM sodium chloride, pH 9.0. The protein was eluted with 50 mM Hepes, 100 mM NaCl, pH 6.9 and passed through a sterile filter into a sterile bag. The eluted sample was tested for bioburden, protein concentration and enzyme activity.

The hydroxyapatite (HAP) column (Biorad) was prepared. The wash was collected and tested for pH, conductivity and endotoxin (LAL assay). The column was equilibrated with 5 mM potassium phosphate, 100 mM NaCl, 0.1 mM $CaCl_2$, pH 7.0. The aminophenyl boronate purified protein was supplemented to final concentrations of 5 mM potassium phosphate and 0.1 mM $CaCl_2$ and loaded onto the HAP column at a flow rate of 100 cm/hr. The column was washed with 5 mM potassium phosphate, pH 7, 100 mM NaCl, 0.1 mM $CaCl_2$. The column was next washed with 10 mM potassium phosphate, pH 7, 100 mM NaCl, 0.1 mM $CaCl_2$. The protein was eluted with 70 mM potassium phosphate, pH 7.0 and passed through a 0.22 μm sterile filter into a sterile bag. The eluted sample was tested for bioburden, protein concentration and enzyme activity.

The HAP purified protein was then passed through a viral removal filter. The sterilized Viosart filter (Sartorius) was first prepared by washing with 2 L of 70 mM potassium phosphate, pH 7.0. Before use, the filtered buffer was sampled for pH and conductivity. The HAP purified protein was pumped via a peristaltic pump through the 20 nM viral removal filter. The filtered protein in 70 mM potassium phosphate, pH 7.0 was passed through a 0.22 μM final filter into a sterile bag. The viral filtered sample was tested for protein concentration, enzyme activity, oligosaccharide, monosaccharide and sialic acid profiling. The sample also was tested for process related impurities.

Example 3

Preparation of PEGylated rHuPH20

In this example, rHuPH20 was PEGylated by reaction of the enzyme with linear N-hydroxysuccinimidyl ester of methoxy poly(ethylene glycol) butanoic acid (mPEG-SBA-30K).

A. Preparation of mPEG-SBA-30K

In order to generate PEGPH20, rHuPH20 (which is approximately 60 KDa in size) was covalently conjugated to a linear N-hydroxysuccinimidyl ester of methoxy poly(ethylene glycol) butanoic acid (mPEG-SBA-30K), having an approximate molecular weight of 30 kDa. The structure of mPEG-SBA is shown below, where n 681.

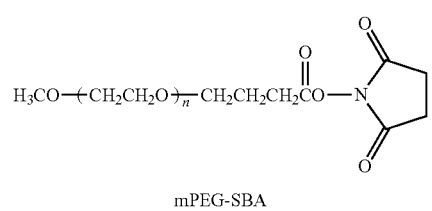

mPEG-SBA

Methods used to prepare the mPEG-SBA-30K that was used to PEGylate rHuPH20 are described, for example, in U.S. Pat. No. 5,672,662. Briefly, the mPEG-SBA-30K is made according to the following procedure:

A solution of ethyl malonate (2 equivalents) dissolved in dioxane is added drop by drop to sodium hydride (2 equivalents) and toluene under a nitrogen atmosphere. mPEG methane sulfonate (1 equivalent, MW 30 kDa, Shearwater)

is dissolved in toluene and added to the above mixture. The resulting mixture is refluxed for approximately 18 hours. The reaction mixture is concentrated to half its original volume, extracted with 10% aqueous NaCl solution, extracted with 1% aqueous hydrochloric acid, and the aqueous extracts are combined. The collected aqueous layers are extracted with dichloromethane (3×) and the organic layer is dried with magnesium sulfate, filtered and evaporated to dryness. The resulting residue is dissolved in 1N sodium hydroxide containing sodium chloride and the mixture is stirred for 1 hour. The pH of the mixture is adjusted to approximately 3 by addition of 6N hydrochloric acid. The mixture is extracted with dichloromethane (2×).

The organic layer is dried over magnesium sulfate, filtered, concentrated, and poured into cold diethyl ether. The precipitate is collected by filtration and dried under vacuum. The resulting compound is dissolved in dioxane and refluxed for 8 hours and then concentrated to dryness. The resulting residue is dissolved in water and extracted with dichloromethane (2×), dried over magnesium sulfate, and the solution is concentrated by rotary evaporation and then poured into cold diethyl ether. The precipitate is collected by filtration and dried under vacuum. The resulting compound (1 equivalent) is dissolved in dichloromethane and N-hydroxysuccinimide (2.1 equivalents) is added. The solution is cooled to 0° C. and a solution of dicyclohexylcarbodiimide (2.1 equivalents) in dichloromethane is added dropwise. The solution is stirred at room temperature for approximately 18 hours. The reaction mixture is filtered, concentrated and precipitated in diethyl ether. The precipitate is collected by filtration and dried under vacuum to afford the powder mPEG-SBA-30K which is then frozen at ≤−15° C.

B. Conjugation of mPEG-SBA-30K to rHuPH20

To make the PEGPH20, mPEG-SBA-30K was coupled to the amino group(s) of rHuPH20 by covalent conjugation, providing stable amide bonds between rHuPH20 and mPEG, as shown below, where n≈681.

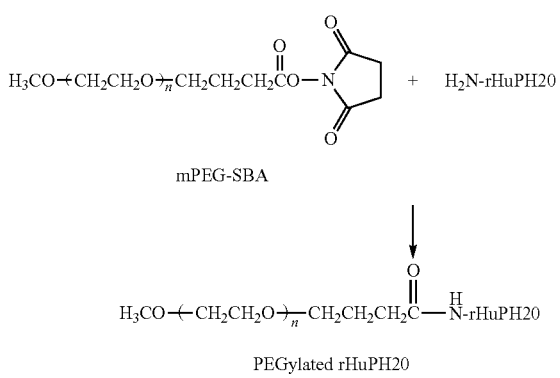

PEGylated rHuPH20

Prior to congutation, the rHuPH20 purified bulk protein made in Example 2B was concentrated to 10 mg/mL, using a 10 kDa polyethersulfone (PES) tangential flow filtration (TFF) cassettes (Sartorius) with a 0.2 m² filtration area, and buffer exchanged against 70 mM Potassium Phosphate at pH 7.2. The concentrated protein was then stored at 2-8° C. until use.

To conjugate the rHuPH20, the mPEG-SBA-30K (Nektar) was thawed at room temperature in the dark for not longer than 2 hours. Depending on the batch size, a sterile 3" stir bar was placed into a 1 or 3 liter Erlenmeyer flask and buffer exchanged rHuPH20 protein was added. Five grams of dry mPEG-SBA-30K powder per gram of rHuPH20 (10:1 molar ratio of mPEG-SBA-30K:rHuPH20) was added to the flask under a vacuum hood and the mixture was mixed for 10 minutes or until the mPEG-SBA-30K was complete dissolved. The stir rate was set such that vortexing occurred without foaming.

The solution was then filtered under a class 100 hood by pumping the solution, via peristaltic pump, through a 0.22 μm polystyrene, cellulose acetate filter capsule (Corning 50 mL Tubetop filter) into a new 1 or 3 liter Erlenmeyer flask containing a sterile 3" stir bar. The volume of the PEGPH20 reaction mixture was determined by mass (1 g/mL density) and the 0.22 μm filter used for filtration was examined in a post-use integrity test.

The mixture was then placed on a stir plate at 2-8° C. and mixed for 20±1 hours in the dark. The stir rate was again set such that vortexing occurred without foaming. The entire Erlenmeyer container was wrapped in foil to protect the solution from light. After mixing, the reaction was quenched by adding 1M glycine to a final concentration of 25 mM. Samples were removed from the container to test pH and conductivity. The pH and conductivity were then adjusted by adding to a solution of mM Tris Base (5.65 L/L) and 5 mM Tris, 10 mM NaCl, pH 8.0 (13.35 L/L) to proceed with Q Sepharose purification.

A QFF Sepharose (GE Healthcare) ion exchange column (Height=21.5-24.0 cm, Diameter=20 cm) was prepared by equilibration with 5 column volumes (36 L) of 5 mM Tris, 10 mM NaCl, pH 8.0. The congugated product was loaded onto the QFF column at a flow rate of 95 cm/hr. The column was then washed with 11 L of equilibration buffer (5 mM Tris, 10 mM NaCl, pH 8.0) at a flow rate of 95 cm/hr followed by a wash with 25 L of equilibration buffer at a flow rate of 268 cm/hr. The protein product was then eluted with 5 mM Tris, 130 mM NaCl, pH 8.0 at a flow rate of 268 cm/hr. The resulting purified PEGPH20 was concentrated to 3.5 mg/mL, using a 30 lcDa polyethersulfone (PES) tangential flow filtration (TFF) cassettes (Sartorius) with a 0.2 m² filtration area, and buffer exchanged against 10 mM Histidine, 130 mM NaCl at pH 6.5. The resulting material was tested for enzyme activity as described in Example 4 below. The PEGylated rHuPH20 material at a concentration of 3.5 mg/mL (final enzyme activity 140,000 U/mL) was filled, in 3 mL volumes, into 5 mL glass vials with a siliconized bromobutyl rubber stopper and aluminum flip-off seal, and frozen (frozen overnight in a −20° C. freezer, then put in a −80° C. freezer for longer storage). The PEGylated rHuHP20 contained approximately 4.5 moles of PEG per mole of rHuPH20.

Example 4

Determination of Hyaluronidase Activity of Soluble rHuPH20

Hyaluronidase activity of soluble rHuPH20 in samples such as cell cultures, plasma, purification fractions and purified solutions was determined using either a turbidimetric assay, which is based on the formation of an insoluble precipitate when hyaluronic acid binds with serum albumin, or a biotinylated-hyaluronic acid substrate assay, which measures the amount of enzymatically active rHuPH20 or PEGPH20 by the digestion of biotinylated hyaluronic acid (b-HA) substrate non-covalently bound to plastic multi-well microtiter plates.

A. Microturbidity Assay

Hyaluronidase activity of soluble rHuPH20 is measured by incubating soluble rHuPH20 with sodium hyaluronate (hyaluronic acid) for a set period of time (10 minutes) and then precipitating the undigested sodium hyaluronate with the addition of acidified serum albumin. The turbidity of the resulting sample is measured at 640 nm after a 30 minute development period. The decrease in turbidity resulting from enzyme activity on the sodium hyaluronate substrate is a measure of the soluble rHuPH20 hyaluronidase activity. The method is performed using a calibration curve generated with dilutions of a soluble rHuPH20 assay working reference standard, and sample activity measurements are made relative to this calibration curve.

Dilutions of the sample were prepared in Enzyme Diluent Solutions. The Enzyme Diluent Solution was prepared by dissolving 33.0±0.05 mg of hydrolyzed gelatin in 25.0 mL of the 50 mM PIPES Reaction Buffer (140 mM NaCl, 50 mM PIPES, pH 5.5) and 25.0 mL of sterile water for injection (SWFI), and diluting 0.2 mL of 25% Buminate solution into the mixture and vortexing for 30 seconds. This was performed within 2 hours of use and stored on ice until needed. The samples were diluted to an estimated 1-2 U/mL. Generally, the maximum dilution per step did not exceed 1:100 and the initial sample size for the first dilution was not less than 20 µL. The minimum sample volumes needed to perform the assay were as follows: In-process Samples, FPLC Fractions: 80 µL; Tissue Culture Supernatants: 1 mL; Concentrated Material: 80 µL; Purified or Final Step Material: 80 µL. The dilutions were made in triplicate in a Low Protein Binding 96-well plate, and 30 µL of each dilution was transferred to Optilux black/clear bottom plates (BD BioSciences).

Dilutions of known soluble rHuPH20 with a concentration of 2.5 U/mL were prepared in Enzyme Diluent Solution to generate a standard curve and added to the Optilux plate in triplicate. The dilutions included 0 U/mL, 0.25 U/mL, 0.5 U/mL, 1.0 U/mL, 1.5 U/mL, 2.0 U/mL, and 2.5 U/mL. "Reagent blank" wells that contained 60 µL of Enzyme Diluent Solution were included in the plate as a negative control. The plate was then covered and warmed on a heat block for 5 minutes at 37° C. The cover was removed and the plate was shaken for 10 seconds. After shaking, the plate was returned to the heat block and the MULTIDROP 384 Liquid Handling Device was primed with the warm 0.25 mg/mL sodium hyaluronate solution (prepared by dissolving 100 mg of sodium hyaluronate (LifeCore Biomedical) in 20.0 mL of SWFI. This was mixed by gently rotating and/or rocking at 2-8° C. for 2-4 hours, or until completely dissolved). The reaction plate was transferred to the MULTIDROP 384 and the reaction was initiated by pressing the start key to dispense 30 µL sodium hyaluronate into each well. The plate was then removed from the MULTIDROP 384 and shaken for 10 seconds before being transferred to a heat block with the plate cover replaced. The plate was incubated at 37° C. for 10 minutes.

The MULTIDROP 384 was prepared to stop the reaction by priming the machine with Serum Working Solution and changing the volume setting to 240 µL. (25 mL of Serum Stock Solution [1 volume of Horse Serum (Sigma) was diluted with 9 volumes of 500 mM Acetate Buffer Solution and the pH was adjusted to 3.1 with hydrochloric acid] in 75 mL of 500 mM Acetate Buffer Solution). The plate was removed from the heat block and placed onto the MULTIDROP 384, and 240 µL of serum Working Solutions was dispensed into the wells. The plate was removed and shaken on a plate reader for 10 seconds. After a further 15 minutes, the turbidity of the samples was measured at 640 nm and the hyaluronidase activity (in U/mL) of each sample was determined by fitting to the standard curve.

Specific activity (Units/mg) was calculated by dividing the hyaluronidase activity (U/ml) by the protein concentration (mg/mL).

B. Biotinylated Hyaluronan Assay

The biotinylated-hyaluronic acid assay measures the amount of enzymatically active rHuPH20 or PEGPH20 in biological samples by the digestion of a large molecular weight (~1.2 megadaltons) biotinylated hyaluronic acid (b-HA) substrate non-covalently bound to plastic multi-well microtiter plates. The rHuPH20 or PEGPH20 in standards and samples are allowed to incubate in a plate coated with b-HA at 37° C. After a series of washes, remaining uncleaved/bound b-HA is treated with Streptavidin Horseradish Peroxidase conjugate (SA-HRP). Reaction between immobilized SA-HRP and the chromogenic substrate, 3,3', 5,5'-tetramethylbenzidine (TMB), produces a blue colored solution. After stopping the reaction with acid, formation of the soluble yellow reaction product is determined by reading the absorbance at 450 nm using a microtiter plate spectrophotometer. The decrease in absorbance at 450 nm resulting from enzyme activity on the biotinylated hyaluronic acid (b-HA) substrate is a measure of the soluble rHuPH20 hyaluronidase activity. The method is performed using a calibration curve generated with dilutions of a soluble rHuPH20 or PEGPH20 reference standard, and sample activity measurements are made relative to this calibration curve.

Dilutions of the sample and calibrator were prepared in Assay Diluent. The Assay Diluent was prepared by adding 1% v/v pooled plasma (from the appropriate species) to 0.1% (w/v) BSA in HEPES, pH 7.4. This was prepared daily and stored at 2-8° C. Depending upon the species type as well as the anticipated hyaluronidase level, single or multiple dilutions were prepared to ensure at least one sample dilution would fall within the range of the calibration curve. To guide the selection of test sample dilution(s), information known about the dose of hyaluronidase administered, the route of administration, approximate plasma volume of the species and the time point were used to estimate the hyaluronidase activity levels. Each sample dilution was mixed as it was prepared by brief pulse-vortexing and pipet tips were changed in between each dilution. In general, the dilutions began with an initial 50 or 100-fold dilution followed by additional serial dilutions. A seven-point calibration curve of rHuPH20 or PEGPH20 (depending upon the treatment administered) was prepared ranging in concentration from 0.004 to 3.0 U/mL for rHuPH20 and from 0.037 to 27 U/mL for PEGPH20. One-hundred microliters (100 µL) of each test sample dilution and calibration curve point was applied to triplicate wells of a 96-well microtiter plate (Immulon 4HBX, Thermo) that had been previously coated with 100 µL per well of b-HA at 0.1 mg/mL and blocked with 250 µL of 1.0% (w/v) Bovine Serum Albumin in PBS. Plate(s) were covered with an adhesive plate seal and incubated at 37° C. for approximately 90 minutes. At the end of the incubation period, the adhesive seal was removed from the plate, samples were aspirated and the plate washed five (5) times with 300 µL per well Wash Buffer (10 mM Phosphate Buffer, 2.7 mM Potassium Chloride, 137 mM Sodium Chloride, pH 7.4, with 0.05% (v/v) Tween 20, PBST) using an automated plate washer (BioTek ELx405 Select CW, Program '4HBX1'). One hundred microliters of Streptavidin-HRP Conjugate Working Solution [Streptavidin-HRP conjugate (1:5,000 v/v) in 20 mM Tris-HCl, 137 mM Sodium Chloride, 0.025% (v/v) Tween 20, 0.1% (w/v) Bovine Serum Albumin] was added per well. The plate was sealed and allowed to incubate at ambient temperature for approximately 60 minutes without shaking and protected from light. At the end of the incubation period, the adhesive seal was removed from the plate, samples were aspirated and the plate washed five (5) times with 300 µL per well Wash Buffer as described above. TMB solution (at ambient temperature) was added to each well and allowed to incubate protected from light for approximately five (5) minutes at room temperature. TMB Stop Solution (KPL, Catalog #50-85-06) was then added as 100 µL per well. The absorbance of each well at 450 nm was determined using a microtiter plate spectrophotometer. The response of the Calibration Curve on each plate was modeled using a 4-parameter logistic curve fit. The hyaluronidase activity of each unknown was calculated by interpolation from the calibration curve, corrected for sample dilution factor, and reported in U/mL.

Example 5

Electrochemiluminescent Immunoassay for the Detection of Anti-rHuPH20 Antibodies in Plasma In this example, the presence of antibodies in plasma or serum raised against the amino acid portion of PEGPH20 was measured using an electrochemiluminescent (ECL) bridging assay (see Mire-Sluis et al., *Journal of Immunological Methods* 289: 1-16, 2004).

A. Assay Overview

The method was typically performed in three Tiers. In Tier 1, an initial screen was performed on the samples to be tested. Samples that yielded ECL values above a mathmatically determined cut point were tested in Tier 2 while samples that did not yield ECL values above the cut point were reported as negative for anti-rHuPH20 antibodies. Tier 2 assays confirmed positive results from Tier 1 using an unlabled rHuPH20 as a competitive inhibitor and Tier 3 assays were used to confirm at what dilution of the sample the response remains above the cut point. Tier 1 and Tier 2 assessments can be performed concurrently.

B. Preparation of Controls

A 1 mg/mL rabbit anti-rHuPH20 polyclonal antibody working stock was generated by diluting 100 µl of 2.45 mg/mL rabbit anti-rHuPH20 polyclonal antibody into 145 µl of StartingBlock T20 (TBS) Blocking Buffer (Thermo, catalog #37543). This stock was mixed thoroughly and subsequently used to generate a second working stock (100 µg/mL) by diluting 100 µl of the 1 mg/mL rabbit anti-rHuPH20 polyclonal antibody into 900 µl of StartingBlock T20 (TBS) Blocking Buffer (Thermo, catalog #37543). The 100 µg/mL working stock was then used to generate low, mid and high positive controls as outlined in Table 5 below. The negative base pool used was human K3-EDTA plasma (Bioreclamation, Catalog #HMPLEDTA). The diluent was StartingBlock Buffer. The negative control is the negative base pool human plasma alone (unspiked). Baseline samples from each dog were used as the control for the post-PEGPH20 exposure samples.

TABLE 5

Positive and Negative Controls for the Anti-rHuPH20 Assay

| Nominal Concentration (ng/mL) | Concentration of Working Stock (ng/mL) | Volume of Working Stock (µL) | Volume of Plasma (mL) | Total Volume (mL) |
|---|---|---|---|---|
| 1,000 (High) | 100,000 | 200 | 19.8 | 20 |
| 500 (Mid) | 100,000 | 100 | 19.9 | 20 |
| 250 (Low) | 100,000 | 50 | 19.95 | 20 |
| 0 (Negative) | 0 | 0 | 20 | 20 |

High, Mid, Low and Negative controls were pipetted into 100 µl aliquots and stored at −70° C. until use (for up to 1 year from date of preparation).

C. Tier 1 Assay

Blood serum samples to be tested for the presence of anti-rHuPH20 antibodies were collected and stored frozen at −70° C. until use. On the day of sample testing, high, mid, low and negative control samples (Example 5B) were removed from storage and thawed together with test samples at ambient temperature, on ice, or at 2-8° C. until they were thawed. Test samples and control samples were mixed gently and each diluted 1:100 in StartingBlock T20 (TBS) Blocking Buffer (Thermo, catalog #37543) for a total of 200 µl per sample.

A separate 10 mL solution was prepared containing 250 ng/mL of rHuPH20-Bt (Recombinant Human Hyaluronidase-Biotinylated; Millipore, special request) and 250 ng/mL of rHuPH20-Rt (Recombinant Human Hyaluronidase-Ruthenium; Millipore, special request) in StartingBlock T20 (TBS) Blocking Buffer. The solution was mixed gently and 200 µl was added to each of the 200 µl sample and control sample tubes. The tubes were vortexed gently (Vortex Genie, Scientific Industries, Catalog#14-961-26), sealed and incubated overnight for 16-24 hours at 2-8° C. with gentle rocking (Heidolph Rocking Platform Shaker, Model# Polymax 2040), protected from light.

During incubation, a Streptavidin Coated Standard MA2400 96 Plate (Meso Scale Discovery, Catalog# L15SA) was blocked with 300 µl/well StartingBlock (TBS) Blocking Buffer (Thermo, Catalog#37542) for 1-4 hours at ambient temperature with gentle shaking. After blocking was complete, the StartingBlock (TBS) Blocking Buffer was removed by aspiration and the plate washed 3 times with 300 µl/well TBS-T wash buffer (25 mM Tris, 137 mM NaCl, 2.7 mM KCl, 0.05% Tween, pH 7.4±0.1 at ambient temperature) on a Bio-Tek Automated Plate Washer (Model# ELx405).

After aspirating the wash buffer, 100 µl/well of each sample and control sample (each sample in duplicate) was added to a well of the streptavidin coated plate and sealed with an opaque plate sealer (VWR International, Catalog#14230-062). Binding was allowed to proceed for 30±3 minutes at ambient temperature with gentle shaking, protected from light.

During the 30 minute incubation, a 20 mL 1× solution of Read Buffer T with Surfactant (4× Read Buffer; Meso Scale Discovery, Catalog# R92TC) was prepared with ultrapure water. When the sample incubation period was complete, the sample solution was aspirated from the plate (Bio-Tek Automated Plate Washer, Aspirate height 3.048 mm, Horizontal Aprirate Position 1.372 mm, Aspirate Flow Rate 3.0 mm/sec) and the plate washed 3 times on a Bio-Tek Automated Plate Washer with 300 µl/well TBS-T wash buffer (Dispense Flow Rate 5, Dispense Height 15.24 mm). Read Buffer T with Surfactant (1×) was then added to each well of the plate (150 µl/well). Within 30 minutes of adding the Read Buffer T, the plate was read on a Meso Scale Discovery Sector Imager 2400. Data (electrochemiluminescence units)

was collected from the Sector Imager 2400 using Meso Scale Discovery software (Gaithersburg, Md.).

(i) Data Validation

An assay was defined as samples analyzed together on a plate. A minimum of 3 negative controls were run (distributed as one near the front of the plate, one near the middle of the plate and one near the back of the plate, or as two near the front of the plate and two near the back of the plate) and 2 positive controls were run for each concentration (high, mid, low; one near the front of the plate and one near the back of the plate).

The system suitability specifications for each assay were established and documented on a "Test Method Summary Sheet". An assay was acceptable in Tier 1 assays if 1) The coefficient of variation (% CV) of the response (ECL units) of replicates for controls was ≤20.0% (only if the response value was >50 ECL units); 2) The ECL response values for ≥66.0% of the positive controls were within ±50% of the expected ECL response value or the assigned acceptance range as specified on the Test Method Summary Sheet; 3) The mean ECL response value for at least one positive control was within ±50% of the expected ECL response value or the assigned acceptance range as specified on the Test Method Summary Sheet at each concentration level (i.e. low, mid, high controls); 4) The mean ECL response value for at least one positive control was within ±50% of the expected ECL response value or the assigned acceptance range as specified on the Test Method Summary Sheet in each set (front versus back of plate) of controls; 5) The mean ECL response value for the negative controls was within the assigned acceptance range as specified on the Test Method Summary Sheet; and 6) The ECL response values for ≥66.0% of the negative controls was within the assigned acceptance range as specified on the Test Method Summary Sheet.

An assay was acceptable in Tier 2 assays if in addition to the above criteria for Tier 1 assays, the assay also met the following criteria: 1) The percent inhibition for the positive controls was ≥50.0% for at least 50.0% of the positive controls at each concentration; 2) The percent inhibition for the positive controls was ≥50.0% for at least 50.0% of the positive controls in each set (front versus back of the plate); and 3) The percent inhibition was ≥50.0% for ≥75.0% of all positive controls.

A study sample was reanalyzed for any of the following reasons: 1) An equipment malfuntion; 2) The test sample was lost during analytical processing; 3) The % CV between replicate ECL values was >20.0% (This criterion did not apply if the ECL responses of both of the sample replicates were below the assay cut point, or if the ECL responses of both of the sample replicates were above the assay cut point. In addition, this criterion did not apply if the difference between replicate ECL responses was 50 ECL units); 4) The mean ECL value of a sample was the assay cut point in Tier 1 testing. The sample would be considered as a putative positive and submitted for Tier 2 testing, unless Tier 2 testing was performed concurrently; and 5) A documented problem associated with the study sample handling was discovered.

(ii) Data Analysis

A minimum of 3 negative controls were run in each tier. The individual values for the negative control were used to calculate the "floating cut point". The "floating cut point" was calculated from each plate by multiplying the geometric mean value of the 3 negative controls by a constant normalization factor of 1.14 (derived from a parametric analysis of the validation data). This floating cut point had a maximum value as determined by the "Test Method Assay Information Sheet". If the calculated cut point was greater than the maximum cut point listed in the "Test Method Assay Information Sheet", the maximum ECL units was used as the cut point (maximum ECL value is evaluated for every lot of negative base pool).

Based on the cut point, each sample was evaluated. Samples with a mean ECL value less than the cut point were reported as negative for rHuPH20 antibodies. Samples with a mean ECL value greater than or equal to the cut point were classified as "Putative Positive" and subject to Tier 2 testing (which can be performed concurrently). Samples with a mean ECL value greater than or equal to the cut point but had insuffient sample volume to permit Tier 2 testing were reported as "Putative Positive" and not tested further.

D. Tier 2 Assay

Each sample that was identified as being a putative positive in Tier 1, was submitted for Tier 2 testing. Tier 2 testing examined the ability of an unlabeled excess of rHuPH20 to inhibit putative antibody binding to the labeled rHuPH20.

Tier 2 testing was carried out essentially as for Tier 1 testing (Example 5C) except for the initial 1:100 sample dilution in StartingBlock T20 (TBS) Blocking Buffer. In Tier 2, each sample and control sample were diluted 1:100 in StartingBlock T20 (TBS) Blocking Buffer (Thermo, catalog #37543) for a total of 200 µL and also diluted 1:100 in StartingBlock T20 (TBS) Blocking Buffer containing 10 µg/mL rHuPH20 (created as a master mix of 8 mL StartingBlock T20 (TBS) Blocking Buffer with rHuPH20 at a concentration of 10 µg/mL) for a total of 200 µL.

After reading the plate as in Example 5C, the percent of inhibition was calculated according to the following equation: Percent Inhibition=(Mean ECL value of the uninhibited sample) minus (mean ECL value of the inhibited sample) divided by (the mean ECL value of the uninhibited sample) times 100. Any sample confirmed to have 50% inhibition or greater was considered "Antibody Positive" and submitted for Tier 3 testing. Samples with less than 50% inhibition were reported as "Antibody Negative". Samples with 50% or greater inhibition but with insufficient sample to continue to Tier 3 were reported as "Antibody Positive" but not tested in Tier 3.

E. Tier 3 Assay

Each sample that was identified as being "Antibody Positive" in Tier 2, was submitted for titration in Tier 3. Tier 3 titration and testing was carried out essentially as for Tier 1 testing (Example 5C) except that samples were diluted in StartingBlock T20 (TBS) initially 1:100 and then serially diluted in Normal Plasma (as used for the negative control; Negative Base Pool).

After the dilution steps, each of the dilutions were further diluted 1:100 in StartingBlock T20 (TBS) Blocking Buffer (as in Example 5C) to generate the final assay dilution. The assay was then carried out as for Tier 1.

After reading the plate, the titer (the highest sample dilution) that yielded a mean ECL value above the assay cut point was determined. Titrations that had at least one dilution with a mean ECL value ≥ the cut point and one value < the cut point were reported as "Antibody Positive" and the titer was reported as the final dilution where the ECL value was above the cut point. Titrations with all of the dilutions with a mean ECL value ≥ the cut point were reported as "Antibody Positive" and further dilutions were tested. Titrations where only the original 1:100 dilution (as in Tier 1) had a mean ECL value ≥ the cut point were reported as "Antibody Positive −1:5".

Example 6

Effect of PH20 on Musculoskeletal Effects

A. Cynomolgus Monkey

This Example describes the musculoskeletal observations that were observed in a 4-week repeat-dose toxicity study conducted in cynomolgus monkeys following IV administration of PEGPH20. Four groups of monkeys (6 animals per gender, with the exception of the group that received 0.2 mg/kg/dose of PEGPH20, which was 4 animals per gender) received IV twice-weekly doses of vehicle, 0.2, 2.0 or 10.5 mg/kg/dose of PEGPH20, respectively, for 4 consecutive weeks. The twice-weekly IV administration was well tolerated in monkeys, however changes in limb joints were observed. Monkeys exhibited a dose-related decrease in range of motion at the knee and elbow, which showed partial to full recovery following cessation of dosing. Also, there was a moderate decrease in soft tissue mass (skeletal muscle) in a single high-dose animal observed by radiologic examination. This is consistent with the pharmacologic effect of PEGPH20 to remove hyaluronan (HA) and its associated extracellular water from tissues. There were no associated histopathologic changes (cartilage, tendons, ligaments) of the knee joint or skeletal muscle, nor abnormal radiography findings of the knee joint itself although movement range was limited. These observations indicate that PEGPH20 administration can induce or result in transient musculoskeletal effects.

B. Humans

This Example describes the results of a clinical study (Phase 1-101), assessing escalating dosage of PEGPH20 in patients to maintain elevated enzyme levels in the plasma and limit return of HA substrate. The median age of the patients was age 61 (range 56-86) with tumor types including histiocytoma, colorectal, pancreatic, bladder, carcinoid and ovarian. In all cases, the patients entered the program under pain medication related to their presenting condition but not for study drug-related pain.

1. Single Intravenous (IV) Dose of 0.05 mg/kg PEGPH20

Initially, two patients were administered a single intravenous (IV) dose of 0.05 mg/kg PEGPH20. This Example describes that both patients experienced stiffness and severe muscle and joint pain with an onset of approximately 6-10 hours after dosing. The pain lasted more than 9 days with patients experiencing stiffness, muscle and joint pain and weakness that interfered with activities of daily living.

The first patient received an intravenous (IV) dose of 4.6 mg (0.05 mg/kg) of PEGPH20 (patient mass of 92 kg). Approximately 10 hours post-dose, the patient reported bilateral hip pain, with difficulty walking and a moderately severe sore throat. The patient was discontinued from the study after the single dose. On Day 2, the patient reported being unable to get out of bed due to muscle and joint pain and stiffness in the upper and lower extremities. The upper limbs could be moved, with the elbow and wrist joints able to flex and extend, however the knees were stiff and were not able to fully extend. The severity of the muscle/joint pain was Grade 3. Over the course of 3 weeks, the patient showed slow but steady improvement of the musculoskeletal effects.

The second patient received an IV dose of 4.9 mg (0.05 mg/kg) of IV PEGPH20 (patient mass of 98 kg). Between 4 and 8 hours post-dose, the patient reported musculoskeletal pain. The patient was discontinued from the study after the single dose. On Day 2, the patient reported profound pain, initially in the knees, but also in all muscles and bones and a sore throat. The severity of the muscle/joint pain was Grade 3. By Day 5, the patient reported feeling better and by Day 9 the patient reported the musculoskeletal pain to have substantively improved.

The patient plasma samples also were analyzed using a human inflammation multi-analyte profile (MAP) of 46 different cytokines, chemokines, acute-phase reactants, and other plasma inflammatory biomarkers. No notable findings were observed for the first two patient samples, ruling out general inflammation or muscle damage.

2. Twice Weekly Intravenous (IV) Dose at 0.5 µg/kg PEGPH20

Given the severity of the symptoms of the first two patients, a third patient was dosed at 0.0005 mg/kg (0.5 µg/kg) twice weekly. On Day 1, this patient received an IV dose of 0.06155 mg PEGPH20. On Day 3, the patient experienced a one to two minute, spontaneously resolving cramp in his right calf. The patient received the second IV dose of 0.06155 mg PEGPH20 on Day 4. On Day 5, the patient reported repeated muscle cramps in his feet, calves, and thighs, which lasted approximately three to four minutes and occurred approximately six to eight times throughout the day. The cramps were accompanied by muscle soreness and tenderness over the entire body but with no joint involvement. The patient was ambulatory but stiff. The severity of the muscle/joint pain was Grade 3. Due to these musculoskeletal effects, the patient met dose-limiting toxicity and was given no further doses of PEGPH20. The muscle tenderness resolved by Day 21 and the muscle cramps by Day 43.

Hyaluronidase enzyme levels and HA catabolite levels also were measured as indicated above in Example 6B.1. A summary of mean enzyme levels and HA catabolites following dosing with 0.5 µg/kg PEGPH20 also is set forth in Example 11.

3. Single Intravenous (IV) Dose of 0.5 µg/kg PEGPH20 Every 21 days

Three additional patients were also treated with an IV dose of 0.5 µg/kg PEGPH20 every 21 days. Two of the patients received a second dose of 0.5 µg/kg PEGPH20, 21 days after the first dose. Only intermittent Grade 1 or transient Grade 2 musculoskeletal side effects observed in all patients. No dose-limiting toxicities (DLTs) occurred in this dose cohort. Nevertheless, all patients were discontinued due to disease progression.

Hyaluronidase enzyme levels and HA catabolite levels also were measured as indicated above in Example 6B.1. A summary of mean enzyme levels and HA catabolites following dosing with 0.5 µg/kg PEGPH20 also is set forth in Example 11.

4. Single Intravenous (IV) Dose of 0.75 µg/kg PEGPH20 Every 21 Days

Given the attenuation of musculoskeletal effects at the IV dose of 0.5 µg/kg PEGPH20 every 21 days, the dose of PEGPH20 was increased. Four patients were subsequently given an IV dose of 0.75 µg/kg PEGPH20 every 21 days, and the dosage regimine in this cohort included up to three doses were given at this dose level. Generally, only intermittent Grade 1 or transient Grade 2 musculoskeletal side effects observed. All patients were discontinued due to disease progression. A summary of the results of each of the patients is as follows:

The first of the patients had moderately differentiated pancreatic adenocarcinoma and experienced Grade 1 musculoskeletal pain two days after the first cycle 2 dose. The event severity increased to Grade 3 after 10 days. This was not considered a dose-limiting toxicity, since it occurred after the first cycle. The event lasted a total of 14 days (10 days at Grade 1 and four days at Grade 3) and resolved. This patient was withdrawn after two cycles due to disease progression.

The second patient in the cohort had small bowel mesenteric carcinoid tumor and experienced Grade 1 hand cramping seven days after the Cycle 1 dose. The patient was discontinued due to disease progression.

The third patient had ovarian adenocarcinoma and experienced a Grade 2 adverse event of bone pain (sacrum, sternum and knees) and muscle aches on the same day as cycle 1 dose. The muscle aches resolved after 10 days, and the bone pain decreased in severity to Grade 1 after an additional 10 days and resolved after a total of 49 days. That patient discontinued due to disease progression after three cycles. In this patient, cancer antigen-125 (CA-125) was measured, which is a protein that is found at levels in ovarian cancer cells that are elevated compared to normal cells. Notably, CA-125 decreased from 103 U/mL (Cycle 1 Day 1) to 64 U/mL (Cycle 1 Day 15). On Cycle 3 Day 1, which was the last value recorded, CA125 was 116.4 U/mL.

The fourth patient had colon adenocarcinoma and received a total of two cycles. Grade 1 muscle spasms occurred in the upper back two days after the first dose and lasted one day. Grade 1 bilateral hand, knee and shoulder stiffness occurred nine days after the second dose.

Hyaluronidase enzyme levels and HA catabolite levels also were measured as indicated above in Example 6B.1. A summary of mean enzyme levels and HA catabolites following dosing with 0.75 µg/kg PEGPH20 also is set forth in Example 11.

5. Single Intravenous (IV) Dose of 1.0 µg/kg PEGPH20 Every 21 Days

The dose of PEGPH20 was increased 33%, and three patients were given an IV dose of 1.0 µg/kg PEGPH20 every 21 days. Two of the patients had prostate adenocarcinoma and one patient had Non Small Cell Lung Cancer [NSCLC]. There were no dose-limiting toxicities (DLTs) reported. Only one of the patients reported musculoskeletal symptoms, which were categorized as Grade 1 intermittent muscle spasms (ribs, feet, calves), intermittent joint pain and rib pain. The symptoms all started one to three days after the Cycle 1 dose. The rib pain resolved after nine days, the muscle spasm resolved after 43 to 44 days and the hip pain resolved after 45 days.

6. Single Intravenous (IV) Dose of 1.5 µg/kg PEGPH20 Every 21 Days

One patient, with prostate adenocarcinoma, received an IV dose of 1.5 µg/kg PEGPH20 every 21 days. There were no dose-limiting toxicities (DLTs) reported.

7. Summary

Of the 14 patients treated, 3 were discontinued due to adverse events: one receiving 50.0 µg/kg dose twice weekly due to Grade 4 musculoskeletal pain, one receiving 50.0 µg/kg dose twice weekly due to Grade 3 musculoskeletal pain, and one receiving 0.5 µg/kg in a 21 day cycle due to Grade 3 musculoskeletal pain. One patient, receiving 0.5 µg/kg in a 21 day cycle, completed two cycles of therapy and then was discontinued due to disease progression. All other patients were discontinued due to disease progression.

Example 7

Effect of PEGPH20 On Musculoskeletal Effects in Beagle Dogs

A. Tolerability and Pharmacokinetics Dose Range Study in Beagle Dogs

In light of the musculoskeletal observations in monkeys and humans in response to IV PEGPH20, a non-clinical model for these musculoskeletal effects was sought. Due to their docile temperment and ease of handling for procedures and assessments, the beagle dog (BioTox Sciences Contract Research Organization, San Diego, Calif. using BioTox Sciences colony dogs that originated from Marshall Farms USA, Inc., North Rose, N.Y.) was assessed for its ability to model musculoskeletal symptoms similar to those observed in humans, in response to PEGPH20 administration. A tolerability and pharmacokinetics study of single intravenous doses of PEGPH20 in beagle dogs was evaluated. A dose range-finding study was performed to evaluate intravenous (IV) doses of PEGPH20 from 3040 to 47500 Units/kg (0.08 to 1.25 mg/kg).

On Day 1, one male beagle dog was dosed with a bolus injection of 5 mL via percutaneous needle puncture of the cephalic vein with PEGPH20 at the initial dose of 3040 Units/kg (0.08 mg/kg). The dog appeared visably normal until Day 2 when it was observed to exhibit reduced mobility (reduced ability to walk or stand) and tighness of muscles of the neck, back and extremities upon palpation. At 48 hours post-dose, the mobility of the animal had improved and by Day 3, the animal exhibited near-complete recovery. Based on these observations of severe musculoskeletal responses to PEGPH20, the dose escalation study was halted.

B. Musculoskeletal Response to IV PEGPH20 in Beagle Dogs

To confirm and further evaluate the musculoskeletal response to PEGPH20, three male beagle dogs were dosed with 80 mg/kg (3040 U/kg) of PEGPH20, two intravenously (IV) and one subcutaneously (SC), and visually observed for musculoskeletal responses (Table 6). PEGPH20 was administered as a 5 mL/animal IV or SC bolus injection. IV administration was via percutaneous needle puncture of the cephalic vein, whereas SC administration was via percutaneous needle puncture into the dorsal back region, near the shoulders. By 23 hours post-dose (Day 2), all three dogs exhibited reduced mobility (reduced ability to walk or stand), overall decreased activity, and muscle stiffness in the neck, back and extremities upon palpation. By Day 4, each of the musculoskeletal responses had resolved.

TABLE 6

Schedule of Single Dose IV Administration of PEGPH20

| | Dose [Units/kg (mg/kg)] | | |
|---|---|---|---|
| Study Day | DOG 989 (IV dose) | DOG 153 (SC dose) | DOG 288 (IV dose) |
| 1 | 3040 U/kg (0.08 mg/kg) | 3040 U/kg (0.08 mg/kg) | 3040 U/kg (0.08 mg/kg) |
| 2 | 0 | 0 | 0 |
| 3 | 0 | 0 | 0 |

This study confirmed the musculoskeletal findings of the study described in Example 7A and established the Beagle dog as a non-clinical model for PEGPH20-mediated musculoskeletal effects similar to those observed in humans.

C. Repeat PEGPH20 Administration in Beagle Dogs

To investigate the feasibility of repeated administration of PEGPH20 to condition dogs to tolerate subsequent doses of PEGPH20, the three dogs dosed in Example 7B were redosed IV, through the cephalic vein or subcutaneously (SC) via percutaneous needle puncture into the dorsal back region near the shoulders with daily escalating PEGPH20 doses from 1520 to 60800 Units/kg (0.04 to 1.6 mg/kg) according to the schedule shown in Table 7.

TABLE 7

Schedule of Repeat Administration of PEGPH20 with Escalating Doses of PEGPH20

| | Dose [Units/kg (mg/kg)] | | |
|---|---|---|---|
| Study Day | DOG 989 (IV dose) | DOG 153 (SC dose) | DOG 288 (IV dose) |
| 4 | 1520 (0.04) | 1520 (0.04) | 1520 (0.04) |
| 5 | 2280 (0.06) | 2280 (0.06) | 2280 (0.06) |
| 6 | 3040 (0.08) | 3040 (0.08) | 3040 (0.08) |
| 7 | 3800 (0.1) | 3800 (0.1) | 3800 (0.1) |
| 8 | 7600 (0.2) | 7600 (0.2) | 7600 (0.2) |
| 9 | 15200 (0.4) | 15200 (0.4) | 15200 (0.4) |
| 10 | 22800 (0.6) | 22800 (0.6) | 22800 (0.6) |
| 11 | 30400 (0.8) | 30400 (0.8) | 30400 (0.8) |
| 12 | 60800 (1.6) | 60800 (1.6) | 60800 (1.6) |

On Days 4 through 6, all three dogs exhibited musculoskeletal responses to PEGPH20 including reduced mobility (reduced ability to walk or stand), overall decreased activity, and muscle stiffness in the neck, back and extremities upon palpation. While the onset of the musculoskeletal responses on Days 4 through 6 was more rapid (a few hours) than the musculoskeletal responses seen on Day 1 (23 hours), the severity of the responses decreased from Day 4 to Day 6. In addition, recovery from the responses was also more rapid on Days 4 through Day 6 (up to 12 hours) than observed on Day 1 (2 days). No musculoskeletal responses were observed in all three dogs on Day 7 through Day 9. On Day 12, one dog dosed IV (dog 288), exhibited reduced mobility 2 hours after the 60800 Units/kg (1.6 mg/kg) dose with complete recovery within 10 hours post-dose. This same dog also exhibited retching post-dose on Day 10 and retching and vomiting on Day 11 and Day 12.

D. Effect of Immunogenicity of PEGPH20 in Beagle Dogs

Multiple repeated dosing following a break in dosing was examined in the three male beagle dogs from Example 7C above. On Day 17, 26 or 33, one dog received 3040 Units/kg (0.08 mg/kg) PEGPH20 intravenously with a 5 mL bolus injection via percutaneous needle puncture of the cephalic vein according to the schedule in Table 8.

TABLE 8

Schedule of PEGPH20 Dosing

| | Dose [Units/kg (mg/kg)] | | |
|---|---|---|---|
| Study Day | DOG 989 | DOG 153 | DOG 288 |
| 17 | 3040 (0.08) | | |
| 26 | | 3040 (0.08) | |
| 33 | | | 3040 (0.08) |

Immediately post-dose, each of the three dogs was observed to experience a systemic anaphylactoid-like reaction. Reactions included urination, defecation, decreased physical activity, difficulty ambulating, retching and/or vomiting, and increased breathing frequency and depth. Marked recovery occurred within 10 to 25 minutes with complete recovery within 24 hours post-dose. No further changes in animal mobility, activity or muscle tone were observed at any subsequent post-dose time points (animals were observed twice a day until the next dosing event).

Due to the possibilty that the reactions noted above were caused by an immunologic repsonse to the administered PEGPH20 (a human protein), sera from the pre-dose bleeds on Day 17, 26 or 33 and from bleeds from all three dogs on Day 51, were tested for reactivity to recombinant human hyaluronidase (rHuPH20) to establish whether the dogs had mounted a humoral immune response to the PEGPH20.

On Days 17, 26 or 33, blood was drawn before dosing (but after the 12 days of excalating PEGPH20 exposure on Day 1-Day 12), from the dog to be treated on that day. Blood was also drawn from all three dogs on Day 51. Serum isolated from blood was tested for the presence of anti-rHuPH20 antibodies as described in Example 5 above. The results of the assay are shown in Table 9. These results confirm that all three dogs mounted a strong antibody response to the protein component, rHuPH20, of PEGPH20, indicating that PEGPH20 is immunogenic in beagle dogs. This finding is not unexpected since the protein component of PEGPH20 is a human protein.

TABLE 9

Anti-rHuPH20 Serum Antibodies Following Repeat Dosing in Beagle Dogs

| Animal ID No. | Baseline (predose Day 1) | Post-PEGPH20 Exposure (Variable Days) | Post-PEGPH20 Exposure (Day 51) |
|---|---|---|---|
| 989 | Not Detected | Day 17: 1:25,000 | 1:125,000 |
| 153 | Not Detected | Day 26: 1:625,000 | 1:125,000 |
| 288 | Not Detected | Day 33: 1:1,953,125,000 | 1:78,125,000 |

To examine if the antibody response in Beagle dogs lead to a potential clearing or neutralization of the administered PEGPH20, the ability of the re-dose of PEGPH20 to deplete hyaluronan from skeletal muscle was examined.

The same three dogs (989, 153 and 288) were treated with an IV dose of 3040 Units/kg (0.08 mg/kg) PEGPH20 on Day 59. Immediately post-dose, one animal (dog #288) exhibited retching with a complete recovery by 5 minutes. No musculoskeletal effects were observed at any subsequent time point.

Twenty-four hours post-dose (Day 60), skeletal muscle biopsies were taken from each of the three treated dogs and also from an untreated control beagle dog. The medial semitendinosis/medial membranosus muscle(s) were targeted for biopsies. The area of the biopsy was shaved using electric clippers and scrubbed using either Chlorhexidine or Povidone-Iodine solutions. Bupivacaine or Lidocaine (2-3 mg/kg) was injected subcutaneously (SC) in the area of the biopsy for local analgesia. The muscle biopsy was collected using a 2-mm-diameter biopsy needle. A gauze sponge was applied with slight pressure to stop any bleeding. Metacam (meloxicam) 0.2 mg/kg was injected SC to control pain. Biopsy samples were placed in Eppendorf tubes or equivalent with approximately 200 μL 10% neutral-buffered formalin (NBF).

Biopsied tissue samples were stained for tissue HA using a highly specific histochemical staining method. Using this method, tissue biopsies fixed in 10% NBF for 48 hours, were embedded in paraffin, sectioned and probed for HA using a biotinylated HA-binding protein (HABP; Seikagaku, Japan), then probed with FITC-labeled streptavidin (Vector Labs, Canada) for detection. The cell nuclei were counterstained with DAPI (4',6-diamidino-2-phenylindole) reagent. Micrographs were then captured using a Zeiss Microscope (Thornwood, N.Y.) coupled with the Spot imaging program (Diagnostic Instruments, Inc).

Hyaluronan expression in the sections was evaluated visually by the level of green fluorescent intensity present. Hyaluronan staining of the pericellular matrix of skeletal muscle samples taken from all three PEGPH20 treated animals was virtually the same high intensity staining as the hyaluronan staining in tissue samples from untreated control animals revealing that PEGPH20 treatment in these animals did not remove extracellular hyaluronan in skeletal muscle samples. This indicates that the serum anti-rHuPH20 antibodies generated in the beagle dogs in response to repeated PEGPH20 administration, likely possessed PH20 neutralizing activity.

Example 8

Effect of Dexamethasone on PEGPH20 in Beagle Dogs

The beagle dog was identified as a species that exhibits similar musculoskeletal observations, in terms of their presentation and timing for onset and resolution, to those reported in humans, in response to PEGPH20 administration. Therefore, the beagle dog was further explored as a model of the human musculoskeletal responses to PEGPH20 and as a model to examine the treatment of symptoms.

A. Premedication Regimen for Dexamethasone

Studies were carried out to optimize the premedication regimen for dexamethasone.

In one study, four naïve male beagle dogs were orally dosed with 4 mg/dose dexamethasone twice a day on the day of PEGPH20 administration. The first dexamethasone dose was given orally (PO) immediately before PEGPH20 intravenous (IV) administration. The second dexamethasone dose was given orally ~8 hours later. On day 1, one dog was dosed with 3040 U/kg (0.08 mg/kg) PEGPH20 after Dexamethasone. Twenty four hours later (day 2), a second dog was dosed with 5700 U/kg (0.15 mg/kg) PEGPH20 after Dexamethasone. Twenty four hours later (day 3), a third dog was dosed with 11400 U/kg (0.3 mg/kg) PEGPH20 after Dexamethasone. Twenty four hours later (day 4), a fourth dog was dosed with 38000 U/kg (1.0 mg/kg) PEGPH20 after Dexamethasone. Blood was collected pre-PEGPH20 administration, and 0.5 hr, 4 h and 24 h post-PEGPH20 administration. Animals were observed for musculoskeletal effects pre-dose and 0.5, 4, 8 and 24 hours post-dose. None of the 4 dogs developed musculoskeletal responses to PEGPH20 at any dose level at any of the time points tested, indicating that dexamethasone premedication blocked the development of musculoskeletal effects of PEGPH20.

B. Effect of Dexamethasone On PEGPH20-Induced Musculoskeletal Observations

The ability of dexamethasone to ameliorate the musculoskeletal effects of PEGPH20 was confirmed in a further pharmacological study. The four treatment groups (each with 3 beagle dogs) and the days of treatment are shown in Table 10 below. PEGPH20 was administered IV with a 5 mL bolus injection via percutaneous needle puncture of the cephalic vein on study Days 1, 2 and/or 5. Dexamethasone was administered orally immediately before the PEGPH20 injection and approximately 8 hours post injection. All animals were re-dosed 3 days after the first injection except those in the PEGPH20 alone treatment group, which were not re-dosed.

TABLE 10

Study Design of Dexamethasone Premedication Regimen

| Treatment Group | # of dogs | Medication Received on Indicated Study Day | | | |
|---|---|---|---|---|---|
| | | 1 | 2 | 4 | 5 |
| Vehicle Control | 3 | Vehicle Control (API Buffer) | | Vehicle Control (API Buffer) | |
| PEGPH20 alone | 3 | PEGPH20 (0.3 mg/kg) | | | |
| PEGPH20 (low) + Dexamethasone | 3 | | PEGPH20 (0.3 mg/kg) + Dexamethasone (4 mg before PEGPH20 and 4 mg, 8 hr after PEGPH20) | | PEGPH20 (0.3 mg/kg) + Dexamethasone (4 mg before PEGPH20 and 4 mg, 8 hr after PEGPH20) |
| PEGPH20 (high) + Dexamethasone | 3 | | PEGPH20 (1.0 mg/kg) + Dexamethasone (4 mg before PEGPH20 and 4 mg, 8 hr after PEGPH20) | | PEGPH20 (1.0 mg/kg) + Dexamethasone (4 mg before PEGPH20 and 4 mg, 8 hr after PEGPH20) |

Dogs were observed for musculoskeletal response to PEGPH20 immediately after treatment with the first dose of PEGPH20 and also at 0.5, 2, 4, 7, 10, 12, 16, 20, 24, 48, and 72 hours post-dose. After the second dose, animals were observed at 0.5, 2, 4, 7, 10, 12, 16, 20, 24, 48, 72, 96 and 120 hours post second dose. Animals treated with only one dose of PEGPH20 were evaluated at 96 hours, 120 hours, 6, 7, 8, and 9 days post-dose.

Beagle dogs administered PEGPH20 (11400 Units/kg; 0.3 mg/kg) alone showed moderate to severe musculoskeletal observations characterized by reduced mobility (reduced-ability to walk or stand), overall decreased activity and muscle stiffness of the neck, back and extremities upon palpation. In general, the onset of these musculoskeletal observations was first observed approximately 10 hours post-PEGPH20 dose, gradually increased in severity between 12-20 hours post-PEGPH20 dose and were subsequently completely resolved by approximately 72 hours post-PEGPH20 dose. Dexamethasone pre-treatment ameliorated these musculoskeletal symptoms in dogs dosed with PEGPH20 at either 0.3 mg/kg or 1.0 mg/kg at all time points examined.

dog from Example 8B, in Table 10 above. Blood was drawn after dosing with PEGPH20 or Vehicle Control according to Table 11 below.

TABLE 11

Time points of Blood Draws for Pharmacokinetic Measurements

| | Time point of Blood Draw per Treatment Group | | | |
|---|---|---|---|---|
| | Vehicle Control (API Buffer) | PEGPH20 (0.3 mg/kg) | PEGPH20 (0.3 mg/kg) + Dexamethasone (4 mg; BID) | PEGPH20 (1.0 mg/kg) + Dexamethasone (4 mg; BID) |
| Post First Dose | 5 min, 10 min, 30 min, 2 hr, 4 hr, 7 hr, 10 hr, 24 hr, 48 hr, 72 hr | 5 min, 10 min, 30 min, 2 hr, 4 hr, 7 hr, 10 hr, 24 hr, 48 hr, 72 hr, 96 hr, 120 hr, 6 days, 7 days, 8 days, 9 days | 5 min, 10 min, 30 min, 2 hr, 4 hr, 7 hr, 10 hr, 24 hr, 48 hr, 72 hr | 5 min, 10 min, 30 min, 2 hr, 4 hr, 7 hr, 10 hr, 24 hr, 48 hr, 72 hr |
| Post Second dose | 10 min, 30 min, 2 hr, 4 hr, 7 hr, 10 hr, 24 hr, 48 hr, 72 hr, 96 hr, 120 hr | N/A | 10 min, 30 min, 2 hr, 4 hr, 7 hr, 10 hr, 24 hr, 48 hr, 72 hr, 96 hr, 120 hr | 10 min, 30 min, 2 hr, 4 hr, 7 hr, 10 hr, 24 hr, 48 hr, 72 hr, 96 hr, 120 hr |

C. Effect of Dexamethasone on PEGPH20 Hyaluronan Removal

Given that dexamethasone pretreatment ameliorated PEGPH20-induced musculoskeletal responses, the effects of dexamethasone on PEGPH20 removal of hyaluronan were examined in skeletal muscle and skin tissues.

Skeletal muscle and skin tissues were biopsied from each of the three dogs in each treatment group outlined in Table 11, 24 hours before and 24 hours after the first IV dosing of PEGPH20. The medial semitendinosis/medial membranosus muscle(s) were targeted for biopsies. The area of the biopsy was shaved using electric clippers and scrubbed using either Chlorhexidine or Povidone-Iodine solutions. Bupivacaine or Lidocaine (2-3 mg/kg) was injected subcutaneously (SC) in the area of the biopsy for local analgesia. The muscle biopsy was collected using a 2-mm-diameter biopsy needle. A gauze sponge was applied with slight pressure to stop any bleeding. Metacam (meloxicam) 0.2 mg/kg was injected SC to control pain. Biopsy samples were placed in Eppendorf tubes or equivalent with approximately 200 µL 10% neutral-buffered formalin (NBF).

Biopsied tissues samples were stained for tissue HA. Briefly, tissue biopsies fixed in 10% NBF for 48 hours, were embedded in paraffin, sectioned and probed for HA using a biotinylated HA-binding protein (HABP; Seikagaku, Japan), then probed with FITC-labeled streptavidin (Vector Labs, Canada) for detection. The cell nuclei were counterstained with DAPI (4',6-diamidino-2-phenylindole) reagent. Micrographs were then captured using a Zeiss Microscope (Thornwood, N.Y.) coupled with the Spot imaging program (Diagnostic Instruments, Inc).

Hyaluronan expression in the sections was evaluated visually by the level of green fluorescent intensity present. The skeletal muscle and skin tissues from animals treated with Vehicle Control (API buffer) showed a similar pattern of brightly stained pericellular hyaluronan in both pre-treatment and post-treatment samples. While skeletal muscle and skin tissues from animals treated with PEGPH20 (0.3 mg/kg) alone, PEGPH20 (0.3 mg/kg)+dexamethasone (4 mg/dose BID; twice a day) and PEGPH20 (1.0 mg/kg)+dexamethasone (4 mg/dose BID; twice a day) each showed brighly stained pericellular hyaluronan in pre-treatment samples, the post-treatment samples from each of these treatment groups revealed virtually no hyaluronan staining. These findings indicated that dexamethasone did not inhibit the hyaluronan degradating activity of PEGPH20.

D. Effect of Dexamethasone On PEGPH20 Pharmacokinetics

To examine the effects of dexamethasone on PEGPH20 pharmacokinetics, blood samples were collected from each Plasma Hyaluronidase activity was measured at each time point using the biotinylated-hyaluronic acid assay described in Example 4B. Plasma was prepared from collected blood samples and stored frozen at −70° C. until analysis. The lower limit of quantitation for the assay was 2.90 U/mL. Plasma concentration versus time data was analyzed by non-compartmental and compartmental methods using Win-Nonlin Pro version 5.1 (Pharsight Corp., Mountain View, Calif.). Derived PK parameters included AUC, Cmax, and Tmax. Systemic exposure defined by AUC and Cmax was similar between PEGPH20 alone and PEGPH20+dexamethasone when administered intravenously to dogs and the general PK profiles from the three PEGPH20 treatment groups were similar indicating that dexamethasone does not affect the pharmacokinetics of PEGPH20.

HA catabolites also were measured as described in Example 6. The results show the appearance of HA catabolites following administration by PEGPH20, which was not affected by the presence of dexamethasone.

Example 9

Effect of Dexamethasone on the Antitumor or Hyaluronan Degrading Activities of PEGPH20 in Human Prostate or Human Pancreatic Tumor Xenograft Models To examine if dexamethasone interfered with the antitumor or hyaluronan degrading activities of PEGPH20, human prostate cancer or human pancreatic cancer xenograft models were evaluated.

A. PC3 Prostate Cancer Xenograft Models

1. Antitumor Activity in PC3 Prostate Cancer Xenograft Models

Tumor cells from the PC3 prostate carcinoma cell line were grown to approximately 80% confluency then trypsinized, collected, washed once in HBSS (Hank's balance salt solution, Mediatech Inc.), then re-suspended in 50% Matrigel® in HBSS at $2 \times 10^7$ cells/mL on ice before inoculation into animals. Athymic male nude mice (Nu/Nu (Ncr); Taconic Farms; average weight ~20 g) were inoculated intramuscularly (IM) with 0.05 mL of this cell suspension, peritibially, in the left hind leg (adjacent to the tibia periosteum). The implants in the animals were assessed twice a week and allowed to grow to a mean tumor volume of approximately 500 mm³ (Day −2; Table 12). Actual tumor volumes were determined using VisualSonics Vevo 770 high-resolution ultrasound, using two perpendicular axial dimensions.

Animals were sorted randomly and grouped into 6 groups of 8 mice per group (6+2 satellite mice). Treatment groups were vehicle (API buffer), PEGPH20 (157,500 Units/kg, 4.5 mg/kg), low dose dexamethasone (1.25 mg/kg), high dose dexamethasone (5 mg/kg), PEGPH20 (4.5 mg/kg)+low dose dexamethasone (1.25 mg/kg) and PEGPH20 (4.5 mg/kg)+ high dose dexamethasone (5 mg/kg). The dose and frequency of the PEGPH20 (or vehicle) intravenous injections was 157,500 Units/kg or approximately 4.5 mg/kg, every $3^{rd}$ day starting on Day 0 (Days 0, 3, 6, 9, 12) with a total of 5 injections (Q3Dx5) with a dose volume of 0.1 mL. This dosing and frequency regimen was previously shown to inhibit xenograft tumor growth by 34-70%. The doses and frequency of the dexamethasone intraperitonal injections were 1.25 mg/kg at the low dose and 5 mg/kg at the high dose, once a day until Day 13 (QDx13) with a dose volume of 0.1 mL.

The tumor volumes of all mice were measured pre-treatment on Day −2 (average tumor volume of ~500 mm$^3$) and on Day 1, 6, 9, 13, 16 and 20 by capturing images using the VisualSonic ultrasound system and using an ultrasound imaging software program to calculate tumor volume (Table 12). The percent tumor growth inhibition (% TGI) was calculated by the following equation:

$$[1-(T_n-T_0)/(C_n-C_0)]\times 100\%$$

In the above equation, $T_n$ is the average tumor volume in the treatment group at respective day "n" at the indicated timepoint after treatment; $T_0$ is the average tumor volume in the treatment group at Day 0 before treatment; $C_n$ is the average tumor volume in the control group at respective day "n" at the indicated timepoint after treatment with vehicle; and $C_0$ is the average tumor volume in the control group at Day 0 before treatment.

The data in Table 1.2 show that dexamethasone alone had no effect on tumor growth inhibition, with either the low or high dose. The results also show that the effects on tumor growth was similar in the groups treated with PEGPH20 alone versus PEGPH20 and dexamethasone. Thus, the data from the PC3 prostate cancer xenograft models revealed that dexamethasone did not interfere with the effects of PEGPH20 on tumor growth inhibition

TABLE 12

Tumor Volumes and Statistical Analysis of Antitumor Activity of PEGPH20, Dexamethasone as Single-agents and in Combination in PC3 Prostate Cancer Model

| Group | Day −2 | Day 1 | Day 6 | Day 9 | Day 13 | Day 16 | Day 20 |
|---|---|---|---|---|---|---|---|
| API-buffer | 487.3 | 653.1 | 861.5 | 994.5 | 1252.7 | 1528.8 | 1870.5 |
| SE | 51.57 | 70.03 | 56.14 | 71.78 | 91.28 | 95.31 | 144.22 |
| PEGPH20 4.5 mg/kg | 491.10 | 394.38 | 598.39 | 674.83 | 827.53 | 1046.73 | 1310.85 |
| SE | 49.26 | 47.61 | 69.29 | 76.03 | 102.22 | 119.17 | 177.85 |
| p-value | | 0.004 | 0.005 | 0.004 | 0.004 | 0.01 | 0.02 |
| % TGI | | TR | 71 | 64 | 56 | 47 | 41 |
| Dexamethasone 1.25 mg/kg | 486.88 | 636.98 | 727.80 | 964.35 | 1202.35 | 1401.91 | 1792.92 |
| SE | 48.16 | 66.17 | 96.52 | 85.93 | 119.73 | 130.68 | 166.24 |
| Dexamethasone 5 mg/kg | 516.25 | 633.84 | 854.90 | 995.47 | 1211.50 | 1455.27 | 1840.11 |
| SE | 51.14 | 56.61 | 69.60 | 91.98 | 125.39 | 207.27 | 257.18 |
| Dexamethasone 1.25 mg/kg + PEGPH20 4.5 mg/kg | 489.69 | 491.36 | 673.05 | 766.85 | 914.62 | 1067.69 | 1498.98 |
| SE | 45.71 | 62.92 | 78.57 | 83.52 | 98.62 | 148.24 | 223.68 |
| p-value | | 0.05 | 0.04 | 0.029 | 0.012 | 0.01 | |
| % TGI | | 99 | 51 | 45 | 44 | 45 | |
| Dexamethasone 5 mg/kg + PEGPH20 4.5 mg/kg | 493.92 | 471.88 | 661.93 | 693.24 | 839.57 | 995.19 | 1343.58 |
| SE | 44.40 | 54.47 | 58.26 | 60.04 | 71.02 | 63.90 | 76.21 |
| p-value | | 0.03 | 0.01 | 0.003 | 0.002 | 0.0005 | 0.005 |
| % TGI | | TR | 55 | 61 | 55 | 52 | 39 |

SE = Standard Error;
% TGI = % Tumor Growth Inhibition;
TR = Tumor Regression;
p-value = One-tailed Paired Equal Variance Student's T-test 2. Effect of Dexamethasone on PEGPH20 Plasma Enzyme Plasma samples were also collected from individual PC3 tumor-bearing satellite mice of control and treatment group mice 24 hours after the final PEGPH20 and dexamethasone dose at Day 13. Plasma PEGPH20 Hyaluronidase was assessed using the biotinylated-hyaluronic acid assay described in Example 4B. Animals treated with PEGPH20, PEGPH20+low dose dexamethasone and PEGPH20+high dose dexamethasone all had similar levels of plasma hyaluronidase activity indicating that dexamethasone did not interfere with the level of PEGPH20 activity in the plasma of mice.

Plasma samples were additionally used to measure soluble plasma hyaluronan in the control group and each of the treatment groups (R&D Systems Catalog DY3614; ELISA assay). In the vehicle control group, the plasma hyaluronan levels ranged from 800,000 to 900,000 ng/mL. The low dose dexamethasone group had a high range of variability in plasma hyaluronan concentrations (one high concentration and one low concentration but both measurable) but the high dose dexamethasone group had plasma hyaluronan levels ranging between 23,000 and 42,000 ng/mL. Mice treated with PEGPH20 alone or with PEGPH20+dexamethasone (either high or low dose) had no detectable (below limit of quantitation) hyaluronan demonstrating that dexamethasone did not alter the PEGPH20 plasma activity in mice.

Thus, the results show that dexamethasone had no effect on PEGPH20 activity in the plasma.

3. Effect of Dexamethasone on PEGPH20 Hyaluronan Degradation Activity in PC3 Prostate Cancer Xenograft Models Tumor tissues from the two satellite mice from all 6 treatment groups in Example 9A.1 above, were harvested by tissue biopsy on Day 14 and stained for the presence of hyaluronan. Tumor biopsies were fixed in 10% NBF for 48 hours, embedded in paraffin, and sectioned. Samples were probed for hyaluronan using a biotinylated HA-binding protein (HABP), then probed with FITC-labeled streptavidin for detection. The cell nuclei were counterstained with DAPI (4',6-diamidino-2-phenylindole) reagent. Micrographs were then captured using a Zeiss Microscope (Thornwood, N.Y.) coupled with the Spot imaging program (Diagnostic Instruments, Inc).

Hyaluronan expression in the sections was evaluated by the level of green fluorescent intensity in the sections. While significant pericellular hyaluronan staining was present in tumor sections taken from animals treated with vehicle, high dose dexamethasone or low dose dexamethasone, pericellular hyaluronan staining was almost completely absent from tumor sections taken from animals treated with PEGPH20 alone, PEGPH20+low dose dexamethasone, or PEGPH20+high dose dexamethasone. Hyaluronan staining in tissue samples from animals treated with PEGPH20 alone was virtually the same as the hyaluronan staining in tissue samples from animals treated with PEGPH20 in combination with either low or high dose dexamethasone indicating that dexamethasone did not alter the activity of PEGPH20 on the removal of pericellular hyaluronan.

B. BxPC3 Pancreatic Cancer Xenograft Models

To further examine if dexamethasone affected the antitumor or hyaluronan degrading activities of PEGPH20, human pancreatic cancer xenograft models were evaluated.

1. Antitumor Activity in BxPC3 Pancreatic Cancer Xenograft Models

Tumor cells from the BxPC3 pancreatic cancer cell line were grown to approximately 80% confluency, trypsinized, collected, washed once in HBSS (Hank's balance salt solution, Mediatech Inc.), and re-suspended in 50% Matrigel in HBSS at $2 \times 10^7$ cells/mL on ice before inoculation into animals. Athymic female nude mice (average weight ~20 g) were inoculated intramuscularly (IM) with 0.05 mL of cell suspension, peritibially, in the left hind leg (adjacent to the tibia periosteum). The tumors in the animals were assessed twice a week and allowed to grow to a mean tumor volume of approximately 250 mm$^3$ (Day −1; Table 13). Actual tumor volumes were determined using VisualSonics Vevo 770 high-resolution ultrasound.

The animals were randomly grouped into 6 groups of 8 animals per group (6+2 satellite mice) and treated with vehicle (API buffer), PEGPH20 (157,500 Units/kg, 4.5 mg/kg), low dose dexamethasone (1.25 mg/kg), high dose dexamethasone (5 mg/kg), PEGPH20 (4.5 mg/kg)+low dose dexamethasone (1.25 mg/kg) and PEGPH20 (4.5 mg/kg)+ high dose dexamethasone (5 mg/kg). The dose and frequency of the PEGPH20 (or vehicle) intravenous injections was 157,500 Units/kg or approximately 4.5 mg/kg, on Days 0, 3, 7, 10, 13 and 17 for a total of 6 injections starting on Day 0 (dose volume of 0.1 mL). The doses and frequency of the dexamethasone intraperitonal injections was 1.25 mg/kg at the low dose and 5 mg/kg at the high dose, once a day until Day 17 (QDx17) with a dose volume of 0.1 mL.

The tumor volumes of all mice were measured pretreatment on Days −4 and −1 (mean tumor volume of ~250 mm$^3$) and on Days 4, 7, 11, 14 and 17 by capturing images using the VisualSonic ultrasound system and using an ultrasound imaging software program to calculate the tumor volume (Table 13). The percent tumor growth inhibition (% TGI) was calculated as described above in Example 9A.

The data in Table 13 below summarizes the results. The results show that the affects on tumor volume with concurrent administration of dexamethasone, either high or low dose, with PEGPH20 was similar to the results when PEGPH20 was administered alone. The data from the BxPC3 pancreatic cancer xenograft models show that dexamethasone did not interfere with PEGPH20-mediated tumor growth inhibition.

TABLE 13

Tumor Volume and Statistical Analysis of Antitumor Activity of PEGPH20 and Dexamethasone as Single-agents and in Combination.

| Group | Day −4 | Day −1 | Day 4 | Day 7 | Day 11 | Day 14 | Day 17 |
|---|---|---|---|---|---|---|---|
| API-buffer | 201.7 | 281.0 | 517.4 | 598.4 | 772.2 | 974.1 | 1266.2 |
| SE | 33.30 | 36.74 | 70.35 | 60.11 | 81.22 | 114.56 | 172.61 |
| PEGPH20 4.5 mg/kg | 196.87 | 275.75 | 350.44 | 394.40 | 473.50 | 596.96 | 790.16 |
| SE | 34.06 | 47.53 | 65.68 | 73.09 | 92.44 | 112.96 | 160.10 |
| p-value | | | 0.05 | 0.03 | 0.02 | 0.02 | 0.03 |
| % TGI | | | 68 | 63 | 60 | 54 | 48 |
| Dexamethasone 5 mg/kg | 197.29 | 231.18 | 396.26 | 379.39 | 481.54 | 603.82 | 720.95 |
| SE | 34.61 | 44.61 | 82.79 | 62.01 | 66.94 | 95.93 | 115.49 |
| p-value | | | | 0.01 | 0.01 | 0.01 | 0.02 |
| % TGI | | | | 53 | 49 | 46 | 50 |
| Dexamethasone 1.25 mg/kg | 202.85 | 312.65 | 463.51 | 609.40 | 732.92 | 796.84 | 933.86 |
| SE | 38.24 | 48.31 | 55.42 | 104.30 | 95.85 | 100.99 | 120.33 |
| Dexamethasone 5 mg/kg + PEGPH20 4.5 mg/kg | 205.98 | 317.51 | 394.98 | 414.21 | 516.62 | 674.16 | 794.21 |
| SE | 40.68 | 41.62 | 45.53 | 63.27 | 75.87 | 87.85 | 114.50 |
| p-value | | | | 0.03 | 0.02 | 0.03 | 0.02 |
| % TGI | | | | 70 | 59 | 49 | 52 |
| Dexamethasone 1.25 mg/kg + PEGPH20 4.5 mg/kg | 207.68 | 265.19 | 325.49 | 341.39 | 424.14 | 527.05 | 610.31 |

TABLE 13-continued

Tumor Volume and Statistical Analysis of Antitumor Activity of
PEGPH20 and Dexamethasone as Single-agents and in Combination.

| | Day | | | | | | |
|---|---|---|---|---|---|---|---|
| Group | Day −4 | Day −1 | Day 4 | Day 7 | Day 11 | Day 14 | Day 17 |
| SE | 41.97 | 56.80 | 60.12 | 73.10 | 63.41 | 75.65 | 81.90 |
| p-value | | | 0.03 | 0.01 | 0.003 | 0.003 | 0.003 |
| % TGI | | | 74 | 76 | 68 | 62 | 65 |

SE = Standard Error;
% TGI = % Tumor Growth Inhibition;
TR = Tumor Regression;
p-value = One-tailed Paired Equal Variance Student's T-test 2. Effect of Dexamethasone on PEGPH20 Plasma Enzyme Plasma samples were also collected from individual PC3 tumor-bearing satellite mice of control and treatment group mice 24 hours after the final PEGPH20 and dexamethasone dose at Day 17. Plasma PEGPH20 Hyaluronidase activity was assessed using the method described in Example 4. Animals treated with PEGPH20, PEGPH20+low dose dexamethasone and PEGPH20+high dose dexamethasone all had similar levels of plasma hyaluronidase activity indicating that dexamethasone did not interfere with the level of PEGPH20 activity in the plasma of these mice.

Plasma samples were additionally used to measure soluble plasma hyaluronan in the control group and each of the treatment groups (R&D Systems Catalog #DY3614; ELISA assay). In the vehicle control group, the plasma hyaluronan levels ranged from 2,000 to 4,000 ng/mL. The high dose dexamethasone group had a high range of variability in plasma hyaluronan concentrations (one high concentration and one low concentration but both measurable) but the low dose dexamethasone group had plasma hyaluronan levels ranging between 2,000 to 4,000 ng/mL, similar to the control animals. Mice treated with PEGPH20 alone or with PEGPH20+dexamethasone (either high or low dose) had no detectable (below limit of quantitation) hyaluronan demonstrating that dexamethasone did not alter the PEGPH20 plasma activity in these mice.

The data from the BxPC3 pancreatic cancer xenograft models show that dexamethasone also had no effect on PEGPH20 activity in the plasma in this model.

3. Effect of Dexamethasone on PEGPH20 Hyaluronan Degradation Activity in BxPC3 Pancreatic Cancer Xenograft Models Tumor tissues from the two satellite mice from all 6 treatment groups in Example 9B.1 above, were harvested by tissue biopsy on Day 18 and stained for the presence of hyaluronan. Tumor biopsies were fixed in 10% NBF for 48 hours, embedded in paraffin, and sectioned. Samples were probed for hyaluronan using a biotinylated HA-binding protein (HABP), then probed with FITC-labeled streptavidin for detection. The cell nuclei were counterstained with DAPI (4',6-diamidino-2-phenylindole) reagent. Micrographs were then captured using a Zeiss Microscope (Thornwood, N.Y.) coupled with the Spot imaging program (Diagnostic Instruments, Inc).

Hyaluronan expression in the sections was evaluated by the level of green fluorescent intensity in the sections. While significant pericellular hyaluronan staining was present in tumor sections taken from animals treated with vehicle control, high dose dexamethasone, or low dose dexamethasone, hyaluronan staining was almost completely absent from tumor sections taken from animals treated with PEGPH20 alone, PEGPH20+low dose dexamethasone, or PEGPH20+high dose dexamethasone. Hyaluronan staining in tissue samples from animals treated with PEGPH20 alone was virtually the same as the staining in tissue samples from animals treated with PEGPH20 and either low or high dose dexamethasone indicating that similar to the results in the PC3 xenograft model, dexamethasone did not alter the activity of PEGPH20 on the removal of hyaluronan, in the BxPC3 xenograft model.

Example 10

The Effect of Dexamethasone on Musculoskeletal Effects in Humans

This Example describes a study assessing the effect of dexamethasone on ameliorating or reducing the adverse musculoskeletal events that resulted from the administration of PEGPH20 in humans. Dexamethasone was added to a dosing regime as a premedication to eliminate or ameliorate the musculoskeletal effects of PEGPH20 administration. The treatment cycle was defined as a 28-day period, with PEGPH20 administered intravenously (IV) and dexamethasone administered orally. Dosing of PEGPH20 and dexamethasone took place on days 1, 4, 8, 11, 15, 18, 22 and 25 of the 28-day cycle. On each dosing day, a premedication regimen of 4 mg of dexamethasone was administered orally one hour prior to the PEGPH20, followed by a second dose of 4 mg dexamethasone 8-12 hours after PEGPH20 dosing.

A. Inclusion and Exclusion Criteria

Patients were enrolled in the study after signing the informed consent form. The patients had at least one confirmed, advanced, solid tumor; were refractory to standard treatment; had at least one tumor that was measurable by RECIST criteria; had a Karnofsky performance status ≥70%; had an ejection fraction of ≥50%, as determined by echocardiogram at baseline; had a life expectancy of at least 3 months; was not pregnant and agreed to use contraception; and had acceptable organ function as shown by hematology, hepatic, renal and coagulation laboratory assays.

The patients additionally had none of the following exclusion criteria: known brain metastasis; New York Heart Association Class III or IV cardiac disease, myocardial infarction, or cardiac arrhythmia requiring medical therapy; active infection requiring systemic therapy; uncontrolled diabetes requiring insulin therapy; medical conditions requiring heparin therapy; known HIV, hepatitis B or hepatitis C infection; known allergy to hyaluronidase; serious nonmalignant disease; or intolerance to dexamethasone. The patients also agreed to comply with the protocol and not participate in any other concurrent interventional therapeutic study. In all cases, the patients entered the program under pain medication. For example, the first patient in this study was taking oxycodon-acetaminophen & oxycontin for pain related to her presenting condition but not for study drug-related pain.

regime. The second dose of dexamethasone was given 8-12 hours later. NSAIDs (ibuprofen) or cyclobenzaprine were used to treat musculoskeletal pain if it occurred.

During the 28 day cycle, the patient underwent a series of medical and laboratory assessments. A schedule of these assessments and their time-points is shown in Table 14. All data collected at each time-point was recorded on a Case Report Form.

TABLE 14

Schedule of Assessments

| Activity | Screening | Treatment Cycle 1 | | | | | | | |
|---|---|---|---|---|---|---|---|---|---|
| Study Day (Cycle Day) | −10 to −1 | 1 | 2/3 | 4 | 8 | 11 | 15 | 18 | 22 | 25 |
| Signed informed consent | X | | | | | | | | | |
| Inclusion/Exclusion criteria | X | | | | | | | | | |
| Medical history | X | | | | | | | | | |
| Medical history - 28 days | X | | | | | | | | | |
| Physical examination | X | | | | | | | | | |
| Karnofsky performance status | X | | | | | | | | | |
| Vital signs (BP, HR, RR, Temperature) | X | $X^{de}$ | | X | X | X | X | X | X | X |
| Body weight | | $X^d$ | | | | | | | | |
| Target PE | | $X^d$ | | | | | $X^d$ | | | |
| Tumor biopsy tissue sample for HA staining | | X | $X^b$ | | | | | | | |
| 12-lead ECG | | $X^d$ | | | | | | | | |
| Echocardiogram | X | | | | | | $X^d$ | | | |
| Clinical chemistry, CBC, and coagulation parameters | X | $X^d$ | | | $X^d$ | | $X^d$ | | $X^d$ | |
| Inflammatory markers - ESR and CRP | | $X^{cd}$ | X | | | | | | | |
| Urinalysis | X | $X^{cd}$ | | $X^d$ | | | | | | |
| Pregnancy test | X | | | | | | | | | |
| Tumor markers as appropriate | X | $X^d$ | | | | | | | | |
| HA catabolites | | $X^{cd}$ | X | $X^{cd}$ | $X^{cd}$ | $X^{cd}$ | $X^{cd}$ | $X^{cd}$ | $X^{cd}$ | $X^{cd}$ |
| PEGPH20 Immunogenicity plasma sample | | $X^d$ | | | | | X | | | |
| PK blood sample collection | | $X^{cd}$ | X | X | X | X | X | X | X | X |
| Efficacy imaging/radiologic evaluation | X | | | | | | | | | |
| ADC-MRI, DCE-MRI, and/or FDG-PET | X | | $X^a$ | | | | | | | $X^a$ |
| PEGPH20 infusion | | $X^e$ | | $X^e$ | $X^e$ | $X^e$ | $X^e$ | $X^e$ | $X^e$ | $X^e$ |
| Concomitant medications | | X | | X | X | X | X | X | X | X |
| Adverse events | | X | X | X | X | X | X | X | X | X |

$^a$To be performed on day 3 (optimally) or day 4 prior to infusion and at end of cycle 1 (after day 25).
$^b$Post-dose tumor biopsy for HA staining if possible, at any time day 2 or beyond.
$^c$After administration
$^d$Before administration
$^e$During administration
F/U—Follow-up B. Dosing of and Assessment 1. First Patient Initially, one patient with advanced solid tumors who satisfied the inclusion/exclusion criteria was dosed with PEGPH20+dexamethasone twice weekly for 28 days at an initial low dose of 0.5 µg/kg. The first patient was a 55-year old, 68.6 kg female patient, with ovarian cancer.

Approximately one hour prior to PEGPH20 administration, dexamethasone (4 mg) was administered orally. Then, a needle/catheter of the appropriate gauge was placed intravenously and PEGPH20 was administered over 5 minutes as a slow IV push. For PEGPH20, dosing was prescribed on a µg/kg basis, based on the actual patient weight on Day 1. PEGPH20 was supplied as an aqueous solution containing 3.5 mg/mL PEGPH20 with 10 mM histidine and 130 mM NaCl at a pH of 6.5. The dose was diluted with normal saline to a final volume of 10 mL. The starting dose was 0.5 µg/kg, given twice weekly for 28 days as specified by the dosing Adverse events or side effects, including musculoskeletal events and other adverse events, were assessed. Any undesirable medical event was considered an Adverse Event (AE) if its onset occurred during or after the patient's first exposure to PEGPH20 in combination with dexamethasone but no later than 30 days after the last dose (whether or not it was considered related to PEGPH20+dexamethasone).

AEs were categorized by severity (the measure of intensity as opposed to the measure of seriousness) by the Investigator using the NCI CTCAE Version 4.0 and the guidelines presented in Table 15 below. All AEs were additionally classified by the Investigator depending on if the AE were Related, Probably Related, Possibly Related, Unlikely Related or Not Related specifically to the administration of PEGPH20 and/or dexamethasone.

TABLE 15

Classification of Adverse Events by Severity

| Severity | Definition |
| --- | --- |
| Mild (Grade 1) | Symptoms or signs may exist, but are transient and easily tolerated. Intervention is not indicated. |
| Moderate (Grade 2) | Symptoms limit some activities of daily living. Minimal, local, or noninvasive intervention is indicated to avert patient discomfort. |
| Severe (Grade 3 or higher) | Symptoms are incapacitating. Hospitalization of other urgent intervention may be indicated. |

The patient also was monitored for dose-limiting toxicity (DLT). To qualify as a DLT, the adverse event had to have been considered related to PEGPH20+dexamethasone treatment and must have emerged during the first 28 days of therapy. DLT was defined as any National Cancer Institute (NCI) Common Terminology Criteria for Adverse Events (CTCAE) Grade 3 or higher (see Table 15) non-hematologic toxicity. Exceptions to this included nausea and vomiting that occurred without prophylactic anti-emetic therapy but were effectively treated by such therapy, and Grade 3 musculoskeletal toxicities that were readily treated such that they were downgraded to Grade 2 or less, or resolved within 24 hours. DLT was also defined as any ongoing and persistent Grade 2 toxicity that failed to resolve over 21 days and that limited the patient's ability to comply with the protocol therapy. A final DLT definition included any Grade 4 or prolonged Grade 3 hematological toxicity.

After dosing with PEGPH20 in combination with dexamethasone at day 1 and day 4, the patient experienced Grade 1, bilateral knee pain. The $3^{rd}$ dose on day 8 was given without complication. The bilateral knee pain continued to be Grade 1, was intermittent, and did not require therapy or limit ambulation. A physical examination of the knee indicated that there were no physical changes or limitations in movement of the articulation. The adverse event was not considered to be a DLT.

The patient completed the regimen (4 weeks, biweekly dosing on days 1, 4, 8, 11, 15, 18, 22 and 25) with no additional related complications. In addition, the patient also had diarrhea, abdominal distention (Grade 3; not related) and actinic rash (Grade 2) on bilateral upper and lower arms (Grade 2; not related) The patient was discontinued and exited the study due to clinical disease (ovarian cancer) progression.

2. Second Patient

Since the dosing regime of PEGPH20 in combination with dexamethasone was well-tolerated in the first patient, the dose of PEGPH20 was escalated in a second patient with esophageal cancer. The patient, male and 71 years of age, was dosed with 1.6 µg/kg PEGPH20+dexamethasone twice weekly for 28 days. Except for the higher dose, the dosage regimen was the same as in the first patient. Medical and laboratory assessments, including adverse events and DLTs were conducted as described above for the first patient.

Grade 1 musculoskeletal side effects were observed. The adverse effects, all Grade 1, included mild achiness in the lower back, fatigue, achiness and pain in the left hip, muscle cramps in the hands and feet. No DLTs were reported. The patient had adverse events that included fatigue (Grade 1; related), left hip ache (Grade 1; not related to study drug); muscle cramps and lower back achiness (Grade 1; possibly related to study drug).

The patient continued to cycle 2, where the patient received weekly doses. The patient discontinued due to disease progression on Day 15 of Cycle 2.

3. Third Patient

A third patient was dosed at 5.0 µg/kg PEGPH20+dexamethasone twice weekly for 28 days. The first dose was received without complications. On the day of the second dose, the patient had Grade 1 muscle cramps in the hands, which progressed to Grade 3 muscle cramping in the hands, legs feet and toes after the third dose. The patient did not receive any additional infusions and was discontinued from the study.

4. Fourth and Fifth Patients

Due to the Grade 3 muscle cramping experienced after a third dose of 5.0 µg/kg PEGPH20, the dose was reduced to 1.6 µg/kg in two patients, each receiving 1.6 µg/kg PEGPH20+dexamethasone twice weekly for 28 days.

The fourth patient, who had moderately differentiated colon adenocarcinoma, experienced Grade 1 bilateral cramping in the fingers, hands, feet and calves. Notably, a post-dose biopsy of a metastatic lesion of the liver demonstrated a reduction in pericellular HA when compared to an archived tumor biopsy (see Example 11). The patient completed Cycle 2, but was withdrawn from the study prior to starting cycle 3 due to disease progression.

The fifth patient, who had moderately differentiated colorectal adenocarcinoma, reported Grade 1 intermittent bilateral cramping in the thighs starting the same day as the second PEGPH20 dose, which was ongoing. Grade 1 intermittent left knee pain also occurred on a single day, which was one day after the second PEGPH20 dose and re-occurred as Grade 1 on the day the sixth PEGPH20 dose was given. This patient also reported Grade 2 intermittent bilateral cramping in the hands and muscles of the lower extremities, which started the same day as the fourth PEGPH20 dose.

C. Summary of Results

For the study of patients dosed with less than 5.0 µg/kg PEGPH20 in combination with dexamethasone, the adverse effects were mostly musculoskeletal in nature, including bilateral knee pain, right foot muscle cramping, left and right hand muscle cramping, which are all study drug related and are all Grade 1. The five patients were discontinued due to disease progression. One patient, receiving 1.6 µg/kg twice weekly, completed two cycles of therapy and then was discontinued due to disease progression.

In sum, the results show that the use of dexamethasone premedication, 4 mg administered pre- and post-PEGPH20 dosing on the dosing day (one hour prior to and eight to 12 hours post-PEGPH20 administration), has attenuated the severity of musculoskeletal events. Thus, the use of dexamethasone permits tolerable administration of PEGPH20 at higher dosing and dosing frequency than achieved by PEGPH20 in the absence of dexamethasone.

Example 11

Histochemical Detection of HA

Samples for histochemical detection of HA were obtained from a pre-biopsy tumor specimen and a post-cycle 1 metastatic liver biopsy sample from a patient dosed for 4 weeks with 1.6 µg/kg PEGPH20+dexamethasone as described in Example 10. An archived pre-dose biopsy (pre biopsy) obtained in 2007 (3.5 years prior to the PEGPH20 study) and a post-PEGPH20 Cycle 1 (3 days after the last dose) biospsy (Post biopsy) were obtained from a female colon cancer patient with liver metastases. The patient post-treatment biopsy was obtained after one cycle of PEGPH20 treatment at 1.6 μg/kg on a twice weekly schedule with dexamethasone co-treatment.

Briefly, the tumor biopsies were fixed in normal buffered formalin (NBF) and 5 μm sections cut and stained using a biotin labeled hyaluronan binding protein (HABP-bio) (Seikagaku, Japan). After washing to remove the primary reagent, a labeled secondary reagent was used. Nuclei were counter-stained using a DAPI (4',6-diamidino-2-phenylindole) reagent. Micrographs were captured via a Nikon Eclipse TE2000U inverted fluorescent microscope coupled to a Insight FireWire digital camera (Diagnostic Instruments, Michigan) or ZEISS overhead scope (Carl Zeiss, Inc.) that has the same imaging system.

The histochemical staining of the samples with biotinylated-HA binding protein demonstrated a decrease in pericellular and stromal HA levels after one cycle of PEGPH20 treatment. The results are summarized in Table 16. The H score represents the relative intensity of pericellular and stromal HA. The data demonstrates the ability of PEGPH20 to degrade tumor-associated HA.

TABLE 16

Histochemical Detection of HA

| | Pericellular tumor cells (% cells stained) | | | | | Stroma (% area stained) | | | | | % total area | |
|---|---|---|---|---|---|---|---|---|---|---|---|---|
| Specimen | 3+ | 2+ | 1+ | 0 | H | 3+ | 2+ | 1+ | 0 | H | Tumor | Stroma** |
| prebiopsy | 10 | 30 | 25 | 35 | 115 | 30 | 50 | 15 | 5 | 205 | 40 | 50 |
| postbiopsy | 0 | 0 | 25 | 75 | 25 | 30 | 30 | 23 | 17 | 173 | 20 | 5 |

**tumor associated stroma

TABLE 17

Working Standard Solution in HSA

| WSS# | DSS3 | DSS2 | DSS1 | Water (μl) | 25% HSA (μl) | HA0Disac (pmoles in 150 μl) |
|---|---|---|---|---|---|---|
| WSS0 | 0.00 | | | 130.00 | 20.00 | 0 |
| WSS1 | 1.25 | | | 128.70 | 20.00 | 10 |
| WSS2 | 3.13 | | | 126.87 | 20.00 | 25 |
| WSS3 | 6.25 | | | 123.75 | 20.00 | 50 |
| WSS4 | 12.50 | | | 117.50 | 20.00 | 100 |
| WSS5 | | 6.25 | | 123.75 | 20.00 | 250 |
| WSS6 | | 12.50 | | 117.50 | 20.00 | 500 |
| WSS7 | | | 6.25 | 123.75 | 20.00 | 1250 |
| WSS8 | | | 12.50 | 117.50 | 20.00 | 2500 |
| WSS9 | | | 25.00 | 105.00 | 20.00 | 5000 |
| WSS10 | | | 50.00 | 80.00 | 20.00 | 10000 |

Example 12

HPLC Method for the Estimation of Hyaluronan (HA) Level in Plasma

This Example describes a method for the determination of the HA-disaccharide content in plasma. The method employs the hydrolysis of HA with Chondroitinase ABC to release the HA-disaccharides, derivatize them with 2-amino acridone (AMAC) and analyze them on a reverse-phase HPLC coupled with fluorescence detection. Quantitation of the HA-disaccharides is accomplished by comparison with HA-disaccharide standards.

1. Working Standards

In the method, a working standard solution was generated. First, a dilute stock solution (DSS) was generated from an HA-disaccharide Stock Solution (SS). The HA disaccharide SS was generated by adding 1 mL of water to a vial of HA-Disac (V-labs, Cat. No. C3209) containing 2 mg of lyophilized powder to make a uniform suspension. To generate dilute stock solutions, 5 W of the SS solution was diluted with 125 μl of water to generate a DSS1 solution (containing 200 pmoles/μl HA-Disac; 200 nmoles/ml HA-Disac). Five-fold serial dilutions in water were made to generate DSS2 (containing 40 pmoles/μl HA-Disac; 40 nmoles/ml HA-Disac) and then DSS3 (containing 8 pmoles/μl HA-Disac; 8 nmoles/ml HA-Disac). Next, working standard solutions were generated as set forth in 25% human serum albumin (HAS) (ABO Pharmaceuticals, Cat. No. 1500233) or Normal Mouse plasma (Bioreclamation, Cat. No. MSEPLEDTA2-BALB-M) as set forth in Tables 17 and 18.

TABLE 18

Working Standard Solution in Normal Mouse Plasma

| WSS# | DSS3 | DSS2 | DSS1 | Water (μl) | Normal Mouse Plasma (μl) | HA0Disac (pmoles in 150 μl) |
|---|---|---|---|---|---|---|
| WSS0 | 0.00 | | | 50.00 | 100.00 | 0 |
| WSS1 | 1.25 | | | 48.70 | 100.00 | 10 |
| WSS2 | 3.13 | | | 46.87 | 100.00 | 25 |
| WSS3 | 6.25 | | | 43.75 | 100.00 | 50 |
| WSS4 | 12.50 | | | 37.50 | 100.00 | 100 |
| WSS5 | | 6.25 | | 43.75 | 100.00 | 250 |
| WSS6 | | 12.50 | | 37.50 | 100.00 | 500 |
| WSS7 | | | 6.25 | 43.75 | 100.00 | 1250 |
| WSS8 | | | 12.50 | 37.50 | 100.00 | 2500 |
| WSS9 | | | 25.00 | 25.00 | 100.00 | 5000 |
| WSS10 | | | 50.00 | 00.00 | 100.00 | 10000 |

2. Hydrolysis and Derivation of Samples

Next, the sample was hydrolyzed. The sample (e.g. plasma) was prepared by taking approximately 100 μg of protein in a polypropylene tube and adjusting the volume to 340 μl with water. A matrix blank also was prepared by taking dilution buffer (1.59 g HEPES, 5.07 g NaCl, 1800 mL water, pH 7.0) equal to the volume of the sample and adjusting the volume to 340 μl. Hydrolysis of the samples and matrix blank were effected by adding 60 μl of TFA to the sample tube and matrix blank tube and the contents were mix and incubated at 100° C. for 4 hours. The vials were allowed to cool to room temperature. The vials were evaporated to dryness using a speed vac. Then, 300 μl of water was added to each tube and vortexed to resuspend the samples.

For derivation of hydrolyzed samples, blanks and working samples, 45 μl of each sample (sample, blank or working sample) was evaporated to dryness in a speed vac. Then, 10

μl of SAS was added to the dried sample, blank and working standards. Then, 50 μl ABA/NaCNBH3 labeling solution was added. The tubes were vortexed and centrifuged briefly. Then, 440 μl of Mobile Phase A was added and the tubes were mixed well. Mobile Phase A was prepared as follows: 132 mL of 1 M ammonium acetate buffer (Sigma, Cat. No. A7330) was added to a 1 L volumetric flask and water added to fill the flask. Following derivation, nominal on-column loads per 20 μl of injection for the working standards is as set forth in Table 19.

TABLE 19

| WSS # | Fuc (pmol) | GalN (pmol) | GlcN (pmol) | Gal (pmol) | Man (pmol) |
|---|---|---|---|---|---|
| WSS1 | 25 | 3.0 | 105 | 42 | 175 |
| WSS2 | 30 | 3.7 | 127 | 51 | 211 |
| WSS3 | 35 | 4.3 | 150 | 60 | 250 |
| WSS4 | 41 | 5.0 | 173 | 69 | 287 |
| WSS5 | 46 | 5.6 | 195 | 78 | 325 |

3. HPLC

The HPLC column was equilibrated at a flow rate of 1.0 mL/min with the initial mobile phase settings as outlined in Table 20. The system was allowed to equilibrate until the baseline was steady. HPLC analysis was performed with the instrument parameters as outlined in Table 20.

TABLE 20

HPLC Instrument Parameters

| Parameter | Values |
|---|---|
| Column | Bakerbond C18 reversed phase column, 4.6 × 250 mm, 5 um |
| Column Temperature | Room Temperature |
| Mobile Phase A | 0.2% n-butylamine, 0.5% phosphoric acid, 1% tetrahydrofuran in water |
| Mobile Phase B | 50% mobile phase A, 50% acetonitrile |
| Flow Rate | 1.0 mL/min |
| Injection volume | 20 μl |
| Detector | Fluorescence; Excitation 360 nm, Emission 425 nm |
| Sample condition | 4-6° C. |

| Gradient | Time (min) | % A | % B |
|---|---|---|---|
| | 0.0 | 95 | 5 |
| | 25.0 | 95 | 5 |
| | 50.0 | 85 | 15 |
| | 50.1 | 0 | 100 |
| | 60.0 | 0 | 100 |
| | 60.1 | 95 | 5 |
| | 70.0 | 95 | 5 |

The sequence for sample analysis was the following: WSS5 (1 injection) for column conditioning/equilibration/detector gain; water injection (1 injection); WSS3 (3 injections); WSS1 (1 injection); WSS2 (1 injection); WSS4 (1 injection); WSS5 (1 injection); Water (1 injection); Matrix Blank (1 injection); Sample 1 (1 injection); Sample 2 (1 injection); WSS3 (3 injections); Water (1 injection). The system was considered suitable when there was acceptable separation quality; the signal to noise ratio for the shorter monosaccharide peak in the WSS1 sample was equal to or more than 10; the relative standard deviation (RSD) of the peak areas for each monosaccharide standard for the 6 injections of WSS3 was equal or less than 4%; the correlation coefficient (r) was 0.99 (r was measured using software to plot the peak area of each working standard against the on-column load (expressed as pmol) using the first three injections of the WSS3 standard and calculating the slope, intercept and correlation coefficient for the working standards using a linear least square regression model); the peak areas for peaks corresponding to monosaccharides were no more than 2% of the peak area measured for WSS5; and the peak areas for peaks corresponding to monosaccharides in water injection were no more than 0.5% of the peak areas measured for WSS5.

4. Sample Analysis

The average corrected peak area for each monosaccharide in each sample preparation was determined. Valley-to-valley integration was used for the GalN peak. To determine this, the linear curves generated from the working standards were used to calculate the amount of each monosaccharide loaded for each sample preparation. For each type of monosaccharide, the average molar ratio of monosaccharides per protein molecule for each sample was calculated. Then, for each sample, the overall sum of the average molar ratios for all five monosaccharides was determined. The calculations were performed based on the following: Molecular weight (MW) of non-glycosylated hyaluronidase protein is 51106 g/mol; the total volume of each sample was 500 ml; the sample dilution factor is 0.15; the volume of each injection is 20 μl; and the conversion factor from mg to pg is $10^9$. The calculations were performed as follows for each monosaccharide:

The amount of monosaccharide for each preparation was calculated using the following equation:

$$\text{Monosaccharide(pmol)} = \frac{\text{Peak Area} - \text{Intercept}}{\text{Slope}}$$

The number of monosaccharides per protein molecule was calculated by sing the following formula:

$$\text{Monosaccharides per protein ratio} = \frac{\text{Monosaccharide (pmol)} \times \text{MW} \times 500 \ \mu l}{0.1 \ \text{mg} \times 10^9 \times 20 \ \mu l \times 0.15}$$

For each sample, the results for each sample were reported as the monosaccharides per protein ratio for each monosaccharide along with the sum of the five monosaccharide ratios.

Example 13

Pharmacokinetics of PEGPH20 with or without Dexamethasone

In the studies in humans described in Example 6 (PEGPH20) and Example 10 (PEGPH20+dexamethasone), blood samples were collected at scheduled times from the patients. Plasma samples were stored frozen, and concentrations of PEGPH20 were determined by measuring hyaluronidase activity using a modified turbidimetric assay as described in Example 4. The USP turbidimetirc method used for the determination of hyaluronidase activity awas based on the formation of an insoluble precipitate that occurs when HA binds with acidified serum. PEGPH20 concentrations were expressed as units of hyaluronidase activity (U/mL) as interpolated from a calibration curve. Activity was reported to the nearest 1 U/mL, and the analytical methods were applicable for measuring plasma hyaluronidase concentrations as low as 0.3125 U/mL.

1. PEGPH20

Blood samples from patients in Example 6 that received one to three IV doses of PEGPH20 at doses that ranged from 0.5 μg/kg to 50 μg/kg were analyzed for pharmacokinetics of PH20.

For the two patients that initially received a single dose of 50 μg/kg (Example 6B.1), the plasma concentration over time was similar. Maximal PEGPH20 concentrations in the plasma were measured soon after infusion, and steadily disappeared from circulation over time. Pharmacokinetic analysis indicated a small distribution volume, slow plasma clearance and terminal half-life of approximately 2 days. The results show that initially following administration, approximately 30 U/mL of enzyme was measured in the plasma. The level of plasma enzyme steadily decreased over time, but was detectable 24 and 48 hours after administration with less than approximately 2 U/mL present at 72 hours after administration. The PK parameters revealed a plasma half life from 28-48 hours in the patients. Table 21 sets forth a summary of the PK parameters including maximum observed plasma concentration (Cmax; U/mL), absolute/systemic clearance (CL; mL/hr/kg), distribution half-life ($t_{1/2}\alpha$), elimination half-life ($t_{1/2}\beta$), and volume of the central compartment ($V_1$; mL/kg).

TABLE 21

PK Parameters After Single 50 μg/kg Dose of PEGPH20

| Patient | Cmax (U/mL) | CL (mL/hr/kg) | $t_{1/2}\alpha$ (hr) | $t_{1/2}\beta$ (hr) | $V_1$ (mL/kg) |
|---|---|---|---|---|---|
| 1 | 30.5 | 2.44 | 4.77 | 49.4 | 57.96 |
| 2 | 31.3 | 3.29 | 2.47 | 25.9 | 55.93 |

For the remaining twelve patients in the study treated with single or multiple doses of PEGPH20 that ranged from 0.5 μg/kg to 1.5 μg/kg, plasma concentrations were measurable after dosing (but less than or about 1.5 U/mL), but concentrations fell below the limit of quantification (BQL) during the first day. Because plasma concentrations were typically near or below the limit of quantification, sufficient information on the time course of plasma concentrations was not available. Generally, there was a dose-dependent increase in systemic exposure for the first day after IV dosing with PEGPH20 at low doses ranging from 0.5 μg/kg to 1.5 μg/kg.

For the eight patients that received multiple doses in the study in Example 6, measurable plasma concentrations were detected after repeat administration in four of these eight patients. These plasma concentrations were low ranging from 0.34 to 0.83 U/mL and were similar to those detected after the initial dosing.

2. PEGPH20+Dexamethasone

Blood samples from patients in Example 10 that received multiple administrations of PEGPH20 at doses that ranged from 0.5 mg/kg to 5.0 mg/kg were analyzed for pharmacokinetics of PH20.

To facilitate comparison to the pharmacokinetics of PEGPH20 without dexamethasone described above, plasma concentration vs. time data was collected prior to repeat administration of PEGPH20. For patients treated with 0.5 μg/kg or 1.6 μg/kg, maximum plasma concentrations were consistent with those observed in the study without dexamethasone. Concentrations fell to the limit of quantification within the first day. The maximum concentration measured from the single patient treated with 5.0 μg/kg PEGPH20 was approximately 1/10 of the Cmax values detected for the patients treated with 50 μg/kg PEGPH20 in the study without dexamethasone. These results show that plasma pharmacokinetics of PEGPH20 is similar in the presence or absence of dexamethasone.

Example 14

Pharmacodynamics of PEGPH20 with or without Dexamethasone

The enzymatic activity of PEGPH20 was measured by monitoring concentrations of hyaluronan present in the circulation. A disaccharide assay described in Example 12 was used to measure the concentrations of HA and its catabolites in serial plasma samples that were collected at scheduled times from patients in the studies in humans described in Example 6 (PEGPH20) and Example 10 (PEGPH20+dexamethasone).

1. PEGPH20

Blood samples from patients in Example 6 that received one to three IV doses of PEGPH20 at doses that ranged from 0.5 μg/kg to 50 μg/kg were analyzed for HA catabolites. Plasma HA concentrations prior to PEGPH20 dosing were typically less than 1 μg/mL for all patients in the study.

For the patients that received a single 50 μg/kg dose of PEGPH20, plasma concentrations of hyaluronan increased significantly. Despite the relatively more rapid disappearance of PEGPH20 from the plasma (Example 12.1), elevated concentrations of HA appeared to accumulate more slowly and persist for a period greater than 2 weeks (over 400 hours). The prolonged effect on HA catabolism, i.e. sustained HA concentrations in the circulation, is consistent with the enzymatic activity of PEGPH20 in a peripheral compartment or extravascular tissue.

For the remaining 12 patients that were treated with single or multiple doses of PEGPH20 that ranged from 0.5 μg/kg to 1.5 μg/kg, HA catabolite levels increased in a dose-dependent manner over the course of a week. Maximal HA concentrations ($C_{max}$) and one-week area-under-the-curve-estimates ($AUC_{0-168h}$) were also determined for each patient to quantify the pharmacodynamic response. The results showed that systemic exposure to HA catabolites, as measured by maximum plasma concentration or area-under-the-curve, appeared to increase with increasing dose of PEGPH20.

2. PEGPH20+Dexamethasone

Blood samples from patients in Example 10 that received multiple administrations of PEGPH20 at doses that ranged from 0.5 μg/kg to 5.0 μg/kg were analyzed for HA concentrations. Consistent with the observations in the samples from patients receiving only PH20 described above, plasma HA concentration vs. time data increased after administration of PEGPH20. Concentrations of plasma HA measured during the first week of dosing increased with increasing dose of PEGPH20. In the three patients that completed a full cycle of treatment and received 8 doses of PEGPH20, the results showed sustained increased plasma HA concentrations in samples from all three patients measured throughout the dosing period.

Example 15

Magnetic Resonance Imaging

Diffusion weighted MRI was performed using a single shot spin-echo sequence to estimate pixel-by-pixel values for the apparent diffusion coefficient. Dynamic contrast enhanced magnetic resonance imaging (DCE-MRI) included imaging during infusion with a contrast agent. Calibration was accomplished using a two part phantom containing an inner tube and ice/water mixture. Scans were performed pre-treatment and post-treatment.

1. Apparent Diffusion Coefficient Magnetic Resonance Imaging (ADC-MRI)

Apparent diffusion coefficient magnetic Resonance imaging (ADC-MRI) measures the volume of water that has moved across the cell membrane based upon a calculation derived from the pre- and post-treatment scans. ADC-MRI scans were completed for a total of 10 of the 14 patients in the study described in Example 6 and 4 of the 5 patients in the study described in Example 10. Analysis of the images acquired from each patient was performed by a radiologist at Imaging Endpoints (Scottsdale, Ariz.), and quantitative estimates of ADC were computed for tissues in each patient. A summary of the ADC-MRI findings associated with tumor regions is shown in Table 22. As shown in the Table, increases in ADC-MRI were observed in 7 of 14 (50%) of patients following PEGPH20 dosing. Increased ADC values are consistent with the mechanism of action of PEGPH20. ADC values, however, did not change in 5 of 14 patients, and values decreased in 2 of 14 patients.

TABLE 22

ADC-MRI Summary

| Dose & Frequency | Post-Dose Scan Days | Change in Tumor ADC-MRI from baseline |
|---|---|---|
| Example 6 | | |
| 50 µg/kg | D4 | no change |
| 0.5 µg/kg; 2x/wk | D3 | no change |
| 0.5 µg/kg; 21 day cycle | D3 | increase |
| 0.5 µg/kg; 21 day cycle | D4 | decrease in lymph nodes |
| 0.5 µg/kg; 21 day cycle | D3 | increase |
| 0.75 µg/kg; 21 day cycle | D3 | increase |
| 0.75 µg/kg; 21 day cycle | D3 | no change |
| 0.75 µg/kg; 21 day cycle | D3, D30 | increase |
| 1.0 µg/kg; 21 day cycle | D5 | increase |
| 1.5 µg/kg; 21 day cycle | D3 | no change |
| Example 10 | | |
| 1.6 µg/kg + dexamethasone; 2x/wk | D3, D29 | increase |
| 5.0 µg/kg + dexamethasone; 2x/wk | D1, D4 | increase D1 |
| 1.6 µg/kg + dexamethasone; 2x/wk | D2, D25 | decrease D25 |
| 1.6 µg/kg + dexamethasone; 2x/wk | D1, D2 | no change |

2. Dynamic Contrast Enhanced Magnetic Resonance Imaging (DCE-MRI)

Dynamic contrast enhanced magnetic resonance imaging (DCE-MRI) measures blood flow that indicates a change in tumor's vascularity. Scans were completed in 4 of 5 patients in the study described in Example 10. Analysis of images acquired from each patient was performed by a radiologist at Imaging Endpoints (Scottsdale, Ariz.), and quantitative estimates of the volume transfer coefficient (Ktrans), blood volume (Vp) and extracellular volume fraction (Ve) were computed for tissues in each patient. A summary of the DCE-MRI findings associated with tumor regions is set forth in Table 23. Significant increases in the Ktrans parameter were observed in the two patients that were scanned on the day of PEGPH20 dosing. The increase in Ktrans within hours of dosing is consistent with preclinical data that show PEGPH20 causes vascular decompression and increased blood flow (Thompson et al. (2010) *Mol. Cancer Ther.*, 9:3052-64.

TABLE 23

DCE-MRI Summary

| Dose & Frequency | Post-Dose Scan Days | Change in Tumor DCE-MRI from baseline |
|---|---|---|
| 1.6 µg/kg + dexamethasone; 2x/wk | D3, D29 | decrease in ktrans at D29 |
| 5.0 µg/kg + dexamethasone; 2x/wk | D1, D4 | increase in ktrans, Ve, Vp (8 hr). Return to baseline (D4) |
| 1.6 µg/kg + dexamethasone; 2x/wk | D2, D25 | No baseline scan available. Increase in Vp on D25 vs. D2. No change in Ktrans |
| 1.6 µg/kg + dexamethasone; 2x/wk | D1, D2 | Increase in Ktrans (8 hr, 24 hr. Increase in Ve for lung tumor but not liver tumor (D1, D2). No change in Vp |

Example 16

Interspecies Scaling Algorithm

In preclinical models, it was observed that PEGPH20, either alone or in combination with gemcitabine effectively inhibited tumor growth at doses as low as 0.01 to 0.1 mg/kg. To determine the equivalent human exposure at these doses, an interspecies scaling algorithm was used that assumes plasma clearance of PEGPH20 scales in proportion to body weight. Based on this, it was found that the efficacious doses in mice of 0.01 to 0.1 mg/kg scale to human equivalent doses of 0.75 µg/kg to 7.5 µg/kg. As mice have approximately 20 times the circulating levels of HA compared to humans, an equivalent dose of PEGPH20 can have relatively more anti-tumor activity in patients.

Since modifications will be apparent to those of skill in this art, it is intended that this invention be limited only by the scope of the appended claims.

SEQUENCE LISTING (198 sequences)

SEQ ID NO: 1 - protein, 509 aa, Homo sapiens
  precursor human PH20
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVASL

SEQ ID NO: 2 - protein, 474 aa, Homo sapiens
  Mature PH20
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVASL

SEQ ID NO: 3 - protein, 482 aa, Homo sapiens
  precursor soluble rHuPH20
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 4 - protein, 447 aa, Homo sapiens [sequence omitted]

SEQ ID NO: 5 - protein, 446 aa, Homo sapiens
  soluble rHuPH20 1-446
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIF

SEQ ID NO: 6 - protein, 445 aa, Homo sapiens
  soluble rHuPH20 1-445
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQI

SEQ ID NO: 7 - protein, 444 aa, Homo sapiens
  soluble rHuPH20 1-444
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQ

SEQ ID NO: 8 - protein, 443 aa, Homo sapiens
  soluble rHuPH20 1-443
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEP

SEQ ID NO: 9 - protein, 442 aa, Homo sapiens
  soluble rHuPH20 1-442
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEE

SEQ ID NO: 10 - protein, 450 aa, Bos taurus
  hyaluronidase
MRPFSLEVSLHLPWAMAAHLLPVCTLFLNLLSMTQGSRDPVVPNQPFTTIWNANTEWCMKKHGVDVDISIFDVVTNPGQTFRGPNMTIFYSSQLGTYPYYTSAGEPVFGGLPQNASLNAHLARTFQDILAAMPEPRFSGLAVIDWEAWRPRWAFNWDTKDIYRQRSRALVQKQHPDWLAPRVEAAAQDQFEGAAEEWMAGTLKLGQALRPQGLWGFYNFPECYNYDFKSPNYTGRCPLNICAQNDQLGWLWGQSRALYPSIYLPAALEGTKKTQMFVQHRVAEAFRVAAGAGDPKLPVLPYMQLFYDMTNHFLPAEELEHSLGESAAQGAAGVVLWVSWLSTSTKESCQAIKEYVDTTLGPSILNVTSGARLCSQVLCSGHGRCARRPSYPKARLILNSTSFSIKPTPGGGPLTLQGALSLEDRLRMAVEFECRCYRGWRGTRCEQWGMW

SEQ ID NO: 11 - protein, 553 aa, Bos taurus
  PH20
MRMLRRHHISFRSFAGSSGTPQAVFTFLLLPCCLALDFRAPPLISNTSFLWAWNAPVERCVNRRFQLPPDLRLFSVKGSPQKSATGQFITLFYADRLGYYPHIDEKTGKTVFGGIPQLGNLKSHMEKAKNDIAYYIPNDSVGLAVIDWENWRPTWARNWKPKDVYRDESVELVLQKNPQLSFPEASKIAKVDFETAGKSFMQETLKLGKLLRPNHLWGYYLFPDCYNHNHNQPTYNGNCPDVEKRRNDDLEWLWKESTALFPSVYLNIRLKSTQNAALYVRNRVQEAIRLSKIASVESPLPVFVYARPVFTDGSSTYLSQGDLVNSVGEIVSLGASGIIMWGSLNLSLSMQSCMNLGTYLNTTLNPYIINVTLAAKMCSQVLCHNEGVCTRKHWNSSDYLHLNPMNFAIQTGEGGKYTVPGTVTLEDLQKFSDTFYCSCYANIHCKKRVDIKNVHSVNVCMAEDICIDSPVKLQPSDHSSSQEASTTTFSSISPSTTTATVSPCTPEKHSPECLKVRCSEVIPNVTQKACQSVKLKNISYQSPIQNIKNQTTY

SEQ ID NO: 12 - protein, 331 aa, Vespula vulgaris
  hyaluronidase A
SERPKRVFNIYWNVPTFMCHQYDLYFDEVTNFNIKRNSKDDFQGDKIAIFYDPGEFPALLSLKDGKYKKRNGGVPQEGNITIHLQKFIENLDKIYPNRNFSGIGVIDFERWRPIFRQNWGNMKIHKNFSIDLVRNEHPTWNKKMIELEASKRFEKYARFFMEETLKLAKKTRKQADWGYYGYPYCFNMSPNNLVPECDVTAMHENDKMSWLFNNQNVLLPSVYVRQELTPDQRIGLVQGRVKEAVRISNNLKHSPKVLSYWWYVYQDETNTFLTETDVKKTFQEIVINGGDGIIIWGSSSDVNSLSKCKRLQDYLLTVLGPIAINVTEAVN

SEQ ID NO: 13 - protein, 340 aa, Vespula vulgaris
  hyaluronidase B
DRTIWPKKGFSIYWNIPTHFCHNFGVYFKELKQFNIKYNSMNNFRGETISLFYDPGNFPSMVLLKNGTYEIRNEGVPQKGNLTIHLEQFTKELDEIYPKKIAGGIGVIHFHNWRPIFRRNVDNLKINKDISIDLVRKEHPKWDKSMIEKEASNRFETSAKIFMEKTLKLAKEIRKKTEWGYHGYPHCLSGSTDKPSFDCDALSMSENDKMSWLFNNQNVLLPSIYLKNVLKPDEKIHLVQERLKEAIRISKNFKHLPKVLPYWWYTYQDKESIFLTEADVKNTFKEILTNGADGIIIWGVSYELTDRKRCEKLKEYLMKILGPIAFKVTKAVKENTPLNF

SEQ ID NO: 14 - protein, 382 aa, Apis mellifera
  hyaluronidase
MSRPLVITEGMMIGVLLMLAPINALLLGFVQSTPDNNKTVREFNVYWNVPTFMCHKYGLRFEEVSEKYGILQNWMDKFRGEEIAILYDPGMFPALLKDPNGNVVARNGGVPQLGNLTKHLQVFRDHLINQIPDKSFPGVGVIDFESWRPIFRQNWASLQPYKKLSVEVVRREHPFWDDQRVEQEAKRRFEKYGQLFMEETLKAAKRMRPAANWGYYAYPYCYNLTPNQPSAQCEATTMQENDKMSWLFESEDVLLPSVYLRWNLTSGERVGLVGGRVKEALRIARQMTTSRKKVLPYYWYKYQDRRDTDLSRADLEATLRKITDLGADGFIIWGSSDDINTKAKCLQFREYLNNELGPAVKRIALNNNANDRLTVDVSVDQV

SEQ ID NO: 15 - protein, 331 aa, Dolichovespula maculata
  hyaluronidase
SERPKRVFNIYWNVPTFMCHQYGLYFDEVTNFNIKHNSKDDFQGDKISIFYDPGEFPALLPLKEGNYKIRNGGVPQEGNITIHLQRFIENLDKTYPNRNFNGIGVIDFERWRPIFRQNWGNMMIHKKFSIDLVRNEHPFWDKKMIELEASKRFEKYARLFMEETLKLAKKTRKQADWGYYGYPYCFNMSPNNLVPDCDATAMLENDKMSWLFNNQNVLLPSVYIRHELTPDQRVGLVQGRVKEAVRISNNLKHSPKVLSYWWYVYQDDTNTFLTETDVKKTFQEIAINGGDGIIIWGSSSDVNSLSKCKRLREYLLTVLGPITVNVTETVN

SEQ ID NO: 16 - protein, 367 aa, Polistes annularis
  hyaluronidase
YVSLSPDSVFNIITDDISHQILSRSNCERSKRPKRVFSIYWNVPTFMCHQYGMNFDEVTDFNIKHNSKDNFRGETISIYYDPGKFPALMPLKNGNYEERNGGVPQRGNITIHLQQFNEDLDKMTPDKNFGGIGVIDFERWKPIFRQNWGNTEIHKKYSIELVRKEHPKWSESMIEAEATKKFEKYARYFMEETLKLAKKTRKRAKWGYYGFPYCYNVTPNNPGPDCDAKATIENDRLSWMYNNQEILFPSVYVRHEQKPEERVYLVQGRIKEAVRISNNLEHSPSVLAYWWYVYQDKMDIYLSETDVEKTFQEIVTNGGDGIIIWGSSSDVNSLSKCKRLREYLLNTLGPFAVNVTETVNGRSSLNF

SEQ ID NO: 17 - protein, 462 aa, Mus musculus
  hyaluronidase
MLGLTQHAQKVWRMKPFSPEVSPGSSPATAGHLLRISTLFLTLLELAQVCRGSVVSNRPFITVWNGDTHWCLTEYGVDVDVSVFDVVANKEQSFQGSNMTIFYREELGTYPYYTPTGEPVFGGLPQNASLVTHLAHTFQDIKAAMPEPDFSGLAVIDWEAWRPRWAFNWDSKDIYRQRSMELVQAEHPDWPETLVEAAAKNQFQEAAEAWMAGTLQLGQVLRPRGLWGYYGFPDCYNNDFLSLNYTGQCPVFVRDQNDQLGWLWNQSYALYPSIYLPAALMGTGKSQMYVRHRVQEALRVAIVSRDPHVPVMPYVQIFYEMTDYLLPLEELEHSLGESAAQGVAGAVLWLSSDKTSTKESCQAIKAYMDSTLGPFIVNVTSAALLCSEALCSGHGRCVRHPSYPEALLTLNPASFSIELTHDGRPPSLKGTLSLKDRAQMAMKFRCRCYRGWRGKWCDKRGM

SEQ ID NO: 18 - protein, 473 aa, Mus musculus
  Hyaluronidase 2
MRAGLGPIITLALVLEVAWAGELKPTAPPIFTGRPFVVAWNVPTQECAPRHKVPLDLRAFDVKATPNEGFFNQNITTFYYDRLGLYPRFDAAGTSVHGGVPQNGSLCAHLPMLKESVERYIQTQEPGGLAVIDWEEWRPVWVRNWQEKDVYRQSSRQLVASRHPDWPSDRVMKQAQYEFEFAARQFMLNTLRYVKAVRPQHLWGFYLFPDCYNHDYVQNWESYTGRCPDVEVARNDQLAWLWAESTALFPSVYLDETLASSVHSRNFVSFRVREALRVAHTHHANHALPVYVFTRPTYTRGLTGLSQVDLISTIGESAALGSAGVIFWGDSEDASSMETCQYLKNYLTQLLVPYIVNVSWATQYCSWTQCHGHGRCVRRNPSANTFLHLNASSFRLVPGHTPSEPQLRPEGQLSEADLNYLQKHFRCQCYLGWGGEQCQRNYKGAAGNASRAWAGSHLTSLLGLVAVALTWTL

SEQ ID NO: 19 - protein, 412 aa, Mus musculus
  hyalurinidase 3
MIMHLGLMMVVGLTLCLMHGQALLQVPEHPFSVVWNVPSARCKAHFGVHLPLDALGIVANHGQHFHGQNISIFYKNQFGLYPYFGPRGTAHNGGIPQAVSLDHHLARAAHQILHSLGSSFAGLAVLDWEEWYPLWAGNWGPHRQVYLAASWVWTQQMFPGLDPQEQLHKAHTSFEQAARALMEYTLQLGRTLRPSGLWGFYRYPACGNGWHKMASNYTGHCHAAITTQNTQLRWLWAASSALFPSIYLPPRLPLAYRQAFVRHRLEEAFRVALLEHSHPLPVLAYSRLTHRSSGRFLSLDDLMQTIGVSAALGTAGVVLWGDLSFSSSEEKCWRLHDYLVGTLGPYVINVTKADMACSHQRCHGHGRCARKDPGQMEAFLHLQPDDSLGAWNSFRCHCYSGWAGPTCLEPKP

SEQ ID NO: 20 - protein, 435 aa, Sus scrofa
  hyalauronidase
MAAHLLPICTLFLNLLSVAQGSRDPVVLNRPFTTIWNANTQWCLKRHGVDVDVSVFEVVVNPGQTFRGPNMTIFYSSQLGTYPYYTSAGEPVFGGLPQNASLDVHLNRTFKDILAAMPESNFSGLAVIDWEAWRPRWAFNWDAKDIYRQRSRALVQKQHPDWPAPWVEAAAQDQFQEAAQTWMAGTLKLGQTLRPHGLWGFYGFPDCYNYDFQSSNYTGQCPPGVSAQNDQLGWLWGQSRALYPSIYLPSALEGTNKTQLYVQHRVNEAFRVAAAAGDPNLPVLPYAQIFHDMTNRLLSREELEHSLGESAAQGAAGVVLWVSWENTRTKESCQSIKEYVDTTLGPFILNVTSGALLCSQAVCSGHGRCVRRPSHTEALPILNPSSFSIKPTPGGGPLTLQGALSLKDRVQMAEEFQCRCYPGWRGTWCEQQGTR

SEQ ID NO: 21 - protein, 419 aa, Sus scrofa
  hyaluronidase 3
MTMQLGLALVLGVAMCLGCGQPLLRAPERPFCVLWNVPSARCKARFGVHLPLEALGITANHGQRFHGQNITIFYKSQLGLYPYFGPRGTAHNGGIPQAVSLDHHLARAAYQIHRSLRPGFTGLAVLDWEEWCPLWAGNWGRRQAYQAASCAWAQRVYPNLDPQEQLCKARAGFEEAARALMEDTLRLGRMLRPHGLWGFYHYPACGNGWHGTASNYTGHCHAAALARNTQLYWLWAASSALFPSIYLPPGLPPAYHQAFVRYRLEEAFRVALVGHPHPLPVLAYARLTHRNSGRFLSQDELVQTIGVSAALGASGVVLWGDLSFSSSEEECWHLRGYLVGTLGPYVINVTRAAMACSHQRCHGHGRCAWQDPGQLKVFLHLHPGGSPGAWESFSCRCYWGWAGPTCQEPRPELGPEEAT

SEQ ID NO: 22 - protein, 449 aa, Rattus norvegicus
  hyaluronidase 1
MKPFSPEVSPDPCPATAAHLLRTYTLFLTLLELAQGCRGSMVSNRPFITVWNADTHWCLKDHGVDVDVSVFDVVANKEQNFQGPNMTIFYREELGTYPYYTPTGEPVFGGLPQNASLVTHLAHAFQDIKAAMPEPDFSGLAVIDWEAWRPRWAFNWDSKDIYQQRSMELVRAEHPDWPETLVEAEAQGQFQEAAEAWMAGTLQLGQVLRPRGLWGYYGFPDCYNYDFLSPNYTGQCSLSIHDQNDQLGWLWNQSYALYPSIYLPAALMGTGKSQMYVRYRVQEAFRLALVSRDPHVPIMPYVQIFYEKTDYLLPLEELEHSLGESAAQGAAGAVLWISSEKTSTKESCQAIKAYMDSTLGPFILNVTSAALLCSEALCSGRGRCVRHPSYPEALLTLSPASFSIEPTHDGRPLSLKGTLSLKDRAQMAMKFKCRCYRGWSGEWCKKQDM

SEQ ID NO: 23 - protein, 473 aa, Rattus norvegicus
  hyaluronidase 2
MRAGLGPIITLALVLEVAWASELKPTAPPIFTGRPFVVAWNVPTQECAPRHKVPLDLRAFDVEATPNEGFFNQNITTFYYDRLGLYPRFDAAGMSVHGGVPQNGSLCAHLPMLKEAVERYIQTQEPAGLAVIDWEEWRPVWVRNWQEKDVYRQSSRQLVASRHPDWPSDRIVKQAQYEFEFAARQFMLNTLRYVKAVRPQHLWGFYLFPDCYNHDYVQNWDSYTGRCPDVEVAQNDQLAWLWAENTALFPSVYLDKTLASSKHSRNFVSFRVQEALRVAHTHHANHALPVYVFTRPTYTRRLTELNQMDLISTIGESAALGSAGVIFWGDSVYASSMENCQNLKKYLTQTLVPYIVNVSWATQYCSWTQCHGHGRCVRRNPSASTFLHLSPSSFRLVPGRTPSEPQLRPEGELSEDDLSYLQMHFRCHCYLGWGGEQCQWNHKRAAGDASRAWAGAHLASLLGLVAMTLTWTL

SEQ ID NO: 24 - protein, 412 aa, Rattus norvegicus
  hyaluronidase 3
MITQLGLTLVVGLTLCLVHVQALLQVPEFPFSVLWNVPSARCKTRFGVHLPLDALGIIANHGQRFHGQNITIFYKNQFGLYPYFGPRGTAHNGGIPQAVSLDHHLAQAAHQILHNLGSSFAGLAVLDWEEWYPLWAGNWGTHRQVYQAASWAWAQQMFPDLNPQEQLHKAQTGFEQAARALMEHTLRLGQMLRPHGLWGFYRYPVCGNGWHNMASNYTGHCHPAIITRNTQLRWLWAASSALFPSIYLPPRLPPAYHQTFVRHRLEEAFRVALTGHAHPLPVLAYVRLTHRSSGRFLSLDDLMQTIGVSAALGAAGVVLWGDLSVSSSEEECWRLHDYLVGTLGPYVINVTKAATACSHQRCHGHGRCSWKDPGQMEAFLHLQPDDNLGAWKSFRCRCYLGWSGPTCLEPKP

SEQ ID NO: 25 - protein, 545 aa, Oryctolagus cuniculus
  PH20
MGVLKFKHIFFGSAVELSGVFQIVFIFLLIPCCLTANFRAPPVIPNVPFLWAWNAPTEFCLGKSGEPLDMSLFSLFGSPRKNKTGQGITIFYVDRLGYYPYIDPHTGAIVHGRIPQLGPLQQHLTKLRQEILYYMPKDNVGLAVIDWEEWLPTWLRNWKPKDIYRIKSIELVKSQHPQYNHSYATEKAKRDFEKAGKDFMEETLKLGRLLRPNHLWGYYLFPDCYNHHYDKPNLYKGSCFDIEKKRNDDLSWLWKESTALFPSVYLTSRARSATALSKLYVVRNRVHEAIRVSKIPDDKSPLPNFVYTRLVFTDQIFQFLSHHDLVYTIGEIVALGASGIVVWGSQSLARSMKSCLHLDNYMKTILNPYLINVTLAAKMCNQVLCQEQGVCTRKNWNPNDYLHLNPGNFAIQLGSNGTYKVDGKPTLTDLEQFSKNFQCSCYTNLNCKERTDMNNVRTVNVCAVENVCIDTNVGPQAVTYAPKEKKDVAHILSNTTSINSSTTMSLPFPRKHVSGCLLVLCMYSQYLNICYRLVAIGIQHGYYLK

SEQ ID NO: 26 - protein, 476 aa, Ovis aries
  hyaluronidase 2
MWTGLGPAVTLALVLVVAWATELKPTAPPIFTGRPFVVAWDVPTQDCGPRHKMPLDPKDMKAFDVQASPNEGFVNQNITIFYRDRLGMYPHFNSVGRSVHGGVPQNGSLWVHLEMLKGHVEHYIRTQEPAGLAVIDWEDWRPVWVRNWQDKDVYRRLSRQLVASHHPDWPPERIVKEAQYEFEFAARQFMLETLRFVKAFRPRHLWGFYLFPDCYNHDYVQNWETYTGRCPDVEVSRNDQLSWLWAESTALFPSVYLEETLASSTHGRNFVSFRVQEALRVADVHHANHALPVYVFTRPTYSRGLTGLSEMDLISTIGESAALGAAGVILWGDAGFTTSNETCRRLKDYLTRSLVPYVVNVSWAAQYCSWAQCHGHGRCVRRDPNAHTFLHLSASSFRLVPSHAPDEPRLRPEGELSWADRNHLQTHFRCQCYLGWGGEQCQWDRRRAAGGASGAWAGSHLTGLLAVAVLAFTWTS

SEQ ID NO: 27 - protein, 114 aa, Ovis aries
  PH20 partial sequence
LYVRNRVREAIRLSKIASVESPLPVFVYHRPVFTDGSSTYLSQGDLVNSVGEIVALGASGIIMWGSLNLSLTMQSCMNLGNYLNTTLNPYIINVTLAAKMCSQVLCQEQGVCIR

SEQ ID NO: 28 - protein, 414 aa, Pongo pygmaeus
  hyaluronidase 3
MTTRLGPALVLGVALCLGCGQPLPQVPERPFSVLWNVPSAHCKSRFGVHLPLNALGIIANRGQHFHGQNMTIFYKNQLGLYPYFGPKGTAHNGGIPQALPLDRHLALAAYQIHHSLRPGFAGPAVLDWEEWCPLWAGNWGRRRAYQAASWAWAQQVFPDLDPQEQLYKAYTGFEQAARALMEDTLRVAQALRPHGLWGFYHYPACGNGWHSMASNYTGRCHAATLARNTQLHWLWAASSALFPSIYLPPRLPPAHHQAFVRHRLEEAFRVALVGHLPVLAYVRLTHRRSGRFLSQDDLVQTIGVSAALGAAGVVLWGDLSLSSSEEECWHLHDYLVDTLGPYGINVTRAAMACSHQRCHGHGRCARRDPGQMEAFLHLWPDGSLGDWKSFSCHCYWGWAGPTCQEPRLGPKEAV

SEQ ID NO: 29 - protein, 510 aa, Macaca fascicularis
  PH20
MGVLKFKHIFFRSFVKSSGVSQIVFTFLLIPCCLTLNFRAPPIIPNVPFLWAWNAPSEFCLGKFNEPLDMSLFTLMGSPRINVTGQGVTIFYVDRLGYYPYIDLTTGVTVHGGIPQKVSLQDHLDKSKQDILFYMPVDNLGMAVIDWEEWRPTWARNWKPKDVYKNRSIELVQQQNVQLSLPQATDKAKQEFEKAGKDFMLETIKLGRSLRPNHLWGYYLFPDCYNHHYRKPGYNGSCFDVEIKRNDDLSWLWNESTALYPSIYLNTQQSVVVATLYVRNRVREAIRVSKIPDAKNPLPVFVYARLVFTDQVLKFLSREELVSTLGETVALGASGIVIWGSLSITRSMKSCLLLDTYMETILNPYIINVTLAAKMCSQVLCQEQGVCIRKDWNSSDYLHLNPDNFDIRLEKGGKFTVHGKPTVEDLEEFSEKFYCSCYTNLSCKEKADVKDTDAVDVCIADGVCIDASLKPPVETEGSPPIFYNTSSSTVSTTMFIVNILFLIISSVASL

SEQ ID NO: 30 - protein, 529 aa, Cavia porcellus
  PH20
MGAFTFKHSFFGSFVECSGVLQTVFIFLLIPCCLADKRAPPLIPNVPLLWVWNAPTEFCIGGTNQPLDMSFFSIVGTPRKNITGQSITLYYVDRLGYYPYIDPHTGAIVHGGLPQLMNLQQHLRKSRQDILFYMPTDSVGLAVIDWEEWRPTWTRNWRPKDIYRNKSIELVKSQHPQYNHSYAVAVAKRDFERTGKAFMLETLKLGKSLRPSSLWGYYLFPDCYNTHFTKPNYDGHCPPIELQRNNDLQWLWNDSTALYPSVYLTSRVRSSQNGALYVRNRVHESIRVSKLMDDKNPLPIYVYIRLVFTDQTTTFLELDDLVHSVGEIVPLGVSGIIIWGSLSLTRSLVSCIGLENYMKGTLLPYLINVTLAAKMCGQVLCKNQGICTRKDWNTNTYLHLNATNFDIELQQNGKFVVHGKPSLEDLQEFSKNFHCSCYTNVACKDRLDVHNVRSVNVCTANNICIDAVLNFPSLDDDDEPPITDDTSQNQDSISDITSSAPPSSHILPKDLSWCLFLLSIFSQHWKYLL

SEQ ID NO: 31 - protein, 512 aa, Rattus norvegicus
  PH20
MGELQFKWLFWRSFAESGGTFQTVLIFLFIPYSLTVDYRATPVLSDTTFVWVWNVPTEACVENVTEPIDLSFFSLIGSPRKTAIGQPVTLFYVDRLGNYPHIDAQQTEHHGGIPQKGDLTTHLVKAKEDVERYIPTDKLGLAIIDWEEWRPTWMRNWTPKDIYRNKSIELVQAADPAINITEATVRAKAQFEGAAKEFMEGTLKLGKHIRPKHLWGFYLFPDCYNNKFQVDNYDGQCPDVEKKRNDDLDWLWKESTGLYPSVYLKKDLKSSRKATLYVRYRVLESIRVSKVSDESNPVPIFVYIRLVFTDHVSEYLLEDDLVNTIGEIVAQGTSGIIIWDAMSLAQRSAGCPILRQYMKTTLNPYIVNVTLAAKMCSQTLCKEKGMCSRKTESSDAYLHLDPSSFSINVTEAGKYEVLGKPEVKDLEYFSEHFKCSCFSKMTCEETSDMRSIQDVNVCMGDNVCIKATLGPNSAFHLLPGKGLLLMTTLAHILHHLPHDIFVFPWKMLVSTP

SEQ ID NO: 32 - protein, 512 aa, Mus musculus
  PH20
MGELRFKHLFWGSFVESGGTFQTVLIFLLIPCSLTVDYRAAPILSNTTFLWIWNVPTERCVGNVNDPIDLSFFSLIGSPRKTATGQPVTLFYVDRLGLYPHIDANQAEHYGGIPQRGDYQAHLRKAKTDIEHYIPDDKLGLAIIDWEEWRPTWLRNWKPKDNYRNKSIELVQSTNPGLSITEATQKAIQQFEEAGRKFMEGTLHLGKFLRPNQLWGYYLFPDCYNNKFQDPKYDGQCPAVEKKRNDNLKWLWKASTGLYPSVYLKKDLKSNRQATLYVRYRVVEAIRVSKVGNASDPVPIFVYIRLVFTDRTSEYLLEDDLVNTIGEIVALGTSGIIIWDAMSLAQRAAGCPILHKYMQTTLNPYIVNVTLAAKMCSQTLCNEKGMCSRRKESSDVYLHLNPSHFDIMLTETGKYEVLGNPRVGDLEYFSEHFKCSCFSRMTCKETSDVKNVQDVNVCVGDNVCIKAKVEPNPAFYLLPGKSLLFMTTLGHVLYHLPQDIFVFPRKTLVSTP

SEQ ID NO: 33 - protein, 807 aa, Staphylococcus aureus
  hyaluronidase
MTYRIKKWQKLSTITLLMAGVITLNGGEFRSVDKHQIAVADTNVQTPDYEKLRNTWLDVNYGYDKYDENNPDMKKKFDATEKEATNLLKEMKTESGRKYLWSGAETLETNSSHMTRTYRNIEKIAEAMRNPKTTLNTDENKKKVKDALEWLHKNAYGKEPDKKVKELSENFTKTTGKNTNLNWWDYEIGTPKSLTNTLILLNDQFSNEEKKKFTAPIKTFAPDSDKILSSVGKAELAKGGNLVDISKVKLLECIIEEDKDMMKKSIDSFNKVFTYVQDSATGKERNGFYKDGSYIDHQDVPYTGAYGVVLLEGISQMMPMIKETPFNDKTQNDTTLKSWIDDGFMPLIYKGEMMDLSRGRAISRENETSHSASATVMKSLLRLSDAMDDSTKAKYKKIVKSSVESDSSYKQNDYLNSYSDIDKMKSLMTDNSISKNGLTQQLKIYNDMDRVTYHNKDLDFAFGLSMTSKNVARYESINGENLKGWHTGAGMSYLYNSDVKHYHDNFWVTADMKRLSGTTTLDNEILKDTDDKKSSKTFVGGTKVDDQHASIGMDFENQDKTLTAKKSYFILNDKIVFLGTGIKSTDSSKNPVTTIENRKANGYTLYTDDKQTTNSDNQENNSVFLESTDTKKNIGYHFLNKPKITVKKESHTGKWKEINKSQKDTQKTDEYYEVTQKHSNSDNKYGYVLYPGLSKDVFKTKKDEVTVVKQEDDFHVVKDNESVWAGVNYSNSTQTFDINNTKVEVKAKGMFILKKKDDNTYECSFYNPESTNSASDIESKISMTGYSITNKNTSTSNESGVHFELTK

SEQ ID NO: 34 - protein, 371 aa, Streptococcus pyogenes bacteriophage H4489A
  hyaluronidase
MTENIPLRVQFKRMSADEWARSDVILLEGEIGFETDTGFAKFGDGQNTFSKLKYLTGPKGPKGDTGLQGKTGGTGPRGPAGKPGTTDYDQLQNKPDLGAFAQKEETNSKITKLESSKADKSAVYSKAESKIELDKKLSLTGGIVTGQLQFKPNKSGIKPSSSVGGAINIDMSKSEGAAMVMYTNKDTTDGPLMILRSDKDTFDQSAQFVDYSGKTNAVNIVMRQPSAPNFSSALNITSANEGGSAMQIRGVEKALGTLKITHENPNVEAKYDENAAALSIDIVKKQKGGKGTAAQGIYINSTSGTAGKMLRIRNKNEDKFYVGPDGGFHSGANSTVAGNLTVKDPTSGKHAATKDYVDEKIAELKKLILKK

SEQ ID NO: 35 - protein, 1628 aa, Clostridium perfringens
  hyaluronidase
MNKNIRKIITSTVLAAMTISVLPSNLVVFATDGITENFYEIYPKPQEISYSGGEFQISDEINIVYDDGIDTYTKKRVDEVLEASNLEATVSNEIVPGKTNFLVGINESGGVVDNYFNKNIPHDESFFDEKMDANIVSVKDGVIGVIGEDTDSAFYGVTTLKHVFNQLEEGNKIQSFRADDYAEVAHRGFIEGYYGNPWSNEDRAELMKFGGDYKLNQYVFAPKDDPYHNSKWRDLYPEEKLSEIKKLAQVGNETKNRYVYALHPFMNNPVRFDTEENYQNDLGVIKAKFTQLLENDVRQFAILADDASAPAQGASMYVKLLTDLTRWLEEQQSTYPDLKTDLMFCPSDYYGNGSSAQLKELNKAEDNVSIVMTGGRIWGEVDENFANNFMNNISTEGHPGRAPFFWINWPCSDNSKQHLIMGGNDTFLHPGVDPSKIDGIVLNPMQQAEANKSALFAIADYAWNIWDNKEEADENWNDSFKYMDHGTAEETNSSLALREISKHMINQNMDGRVRPLQESVELAPKLEAFKQKYDSGASIKEDALELIAEFTNLQKAADYYKNNPGNERTRDQIIYWLNCWEDTMDAAIGYLKSAIAIEEGDDEAAWANYSEAQGAFEKSKTYGFHYVDHTEYAEVGVQHIVPFIKSMGQNLSVVIGSIVDPNRIIATYISNRQDAPTGNPDNIFDNNASTELVYKNPNRIDVGTYVGVKYSNPITLNNVEFLMGANSNPNDTMQKAKIQYTVDGREWIDLEEGVEYTMPGAIKVENLDLKVRGVRLIATEARENTWLGVRDINVNKKEDSNSGVEFNPSLIRSESWQVYEGNEANLLDGDDNTGVWYKTLNGDTSLAGEFIGLDLGKEIKLDGIRFVIGKNGGGSSDKWNKFKLEYSLDNESWTTIKEYDKTGAPAGKDVIEESFETPISAKYIRLTNMENINKWLTFSEFAIISDELENAGNKENVYTNTELDLLSLAKEDVTKLIPTDDISLNHGEYIGVKLNRIKDLSNINLEISNDTGLKLQSSMNGVEWTEITDKNTLEDGRYVRLINTSNEAVNFNLTKFEVNSNEVYEPSLVDAYVGDDGAKKAVDGDLKTRVKFLGAPSTGDTIVYDLGQEILVDNLKYVVLDTEVDHVRDGKIQLSLDGETWTDAITIGDGVENGVDDMFSTPLKNGYKHGNQSGGIVPIDSAYVEGDNLNQKARYVRILFTAPYRHRWTVINELMINNGEYISTVNDPTYISNPIEERGFAPSNLRDGNLTTSYKPNTNNGEISEGSITYRLSEKTDVRKVTIVQSGSSISNAKVMARVGDGSENVTDQWVQLGTLSNSLNEFINRDYNNIYEIKIEWTDVAPNIYEIITLNQEFEFPVNDSLKAKYDELINLSGDEYTLSSFETLKEALNEAKSILDDSNSSQKKIDKALEKLNKAEERLDLRATDFEDFNKVLTLGNSLVEEEYTAESWALFSEVLEAANEANKNKADYTQDQINQIVIDLDASIKALVKETPEVDKTNLGELINQGKSLLDESVEGFNVGEYHKGAKDGLTVEINKAEEVFNKEDATEEEINLAKESLEGAIARFNSLLIEESTGDFNGNGKIDIGDLAMVSKNIGSTTNTSLDLNKDGSIDEYEISFINHRILN

SEQ ID NO: 36 - protein, 435 aa, Homo sapiens
  Hyaluronidase-1 [Precursor]
MAAHLLPICALFLTLLDMAQGFRGPLLPNRPFTTVWNANTQWCLERHGVDVDVSVFDVVANPGQTFRGPDMTIFYSSQLGTYPYYTPTGEPVFGGLPQNASLIAHLARTFQDILAAIPAPDFSGLAVIDWEAWRPRWAFNWDTKDIYRQRSRALVQAQHPDWPAPQVEAVAQDQFQGAARAWMAGTLQLGRALRPRGLWGFYGFPDCYNYDFLSPNYTGQCPSGIRAQNDQLGWLWGQSRALYPSIYMPAVLEGTGKSQMYVQHRVAEAFRVAVAAGDPNLPVLPYVQIFYDTTNHFLPLDELEHSLGESAAQGAAGVVLWVSWENTRTKESCQAIKEYMDTTLGPFILNVTSGALLCSQALCSGHGRCVRRTSHPKALLLLNPASFSIQLTPGGGPLSLRGALSLEDQAQMAVEFKCRCYPGWQAPWCERKSMW

SEQ ID NO: 37 - protein, 473 aa, Homo sapiens
  Hyaluronidase-2 [Precursor]
MRAGPGPTVTLALVLAVAWAMELKPTAPPIFTGRPFVVAWDVPTQDCGPRLKVPLDLNAFDVQASPNEGFVNQNITIFYRDRLGLYPRFDSAGRSVHGGVPQNVSLWAHRKMLQKRVEHYIRTQESAGLAVIDWEDWRPVWVRNWQDKDVYRRLSRQLVASRHPDWPPDRIVKQAQYEFEFAAQQFMLETLRYVKAVRPRHLWGFYLFPDCYNHDYVQNWESYTGRCPDVEVARNDQLAWLWAESTALFPSVYLDETLASSRHGRNFVSFRVQEALRVARTHHANHALPVYVFTRPTYSRRLTGLSEMDLISTIGESAALGAAGVILWGDAGYTTSTETCQYLKDYLTRLLVPYVVNVSWATQYCSRAQCHGHGRCVRRNPSASTFLHLSTNSFRLVPGHAPGEPQLRPVGELSWADIDHLQTHFRCQCYLGWSGEQCQWDHRQAAGGASEAWAGSHLTSLLALAALAFTWTL

SEQ ID NO: 38 - protein, 417 aa, Homo sapiens
  Hyaluronidase-3 [Precursor]
MTTQLGPALVLGVALCLGCGQPLPQVPERPFSVLWNVPSAHCEARFGVHLPLNALGIIANRGQHFHGQNMTIFYKNQLGLYPYFGPRGTAHNGGIPQALPLDRHLALAAYQIHHSLRPGFAGPAVLDWEEWCPLWAGNWGRRRAYQAASWAWAQQVFPDLDPQEQLYKAYTGFEQAARALMEDTLRVAQALRPHGLWGFYHYPACGNGWHSMASNYTGRCHAATLARNTQLHWLWAASSALFPSIYLPPRLPPAHHQAFVRHRLEEAFRVALVGHRHPLPVLAYVRLTHRRSGRFLSQDDLVQSIGVSAALGAAGVVLWGDLSLSSSEEECWHLHDYLVDTLGPYVINVTRAAMACSHQRCHGHGRCARRDPGQMEAFLHLWPDGSLGDWKSFSCHCYWGWAGPTCQEPRPGPKEAV

SEQ ID NO: 39 - protein, 481 aa, Homo sapiens
  Hyaluronidase-4
MKVLSEGQLKLCVVQPVHLTSWLLIFFILKSISCLKPARLPIYQRKPFIAAWNAPTDQCLIKYNLRLNLKMFPVIGSPLAKARGQNVTIFYVNRLGYYPWYTSQGVPINGGLPQNISLQVHLEKADQDINYYIPAEDFSGLAVIDWEYWRPQWARNWNSKDVYRQKSRKLISDMGKNVSATDIEYLAKVTFEESAKAFMKETIKLGIKSRPKGLWGYYLYPDCHNYNVYAPNYSGSCPEDEVLRNNELSWLWNSSAALYPSIGVWKSLGDSENILRFSKFRVHESMRISTMTSHDYALPVFVYTRLGYRDEPLFFLSKQDLVSTIGESAALGAAGIVIWGDMNLTASKANCTKVKQFVSSDLGSYIANVTRAAEVCSLHLCRNNGRCIRKMWNAPSYLHLNPASYHIEASEDGEFTVKGKASDTDLAVMADTFSCHCYQGYEGADCREIKTADGCSGVSPSPGSLMTLCLLLLASYRSIQL

SEQ ID NO: 40 - protein, 467 aa, Homo sapiens
  sHuPH20 precursor 1-467
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDA

SEQ ID NO: 41 - protein, 477 aa, Homo sapiens
  sHuPH20 precursor 1-477
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEE

SEQ ID NO: 42 - protein, 478 aa, Homo sapiens
  sHuPH20 precursor 1-478
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEP

SEQ ID NO: 43 - protein, 479 aa, Homo sapiens
  sHuPH20 precursor 1-479
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQ

SEQ ID NO: 44 - protein, 480 aa, Homo sapiens
  sHuPH20 precursor 1-480
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQI

SEQ ID NO: 45 - protein, 481 aa, Homo sapiens
  sHuPH20 precursor 1-481
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIF

SEQ ID NO: 46 - protein, 483 aa, Homo sapiens
  sHuPH20 precursor 1-483
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYN

SEQ ID NO: 47 - protein, 432 aa, Homo sapiens
  sHuPH20 mature 36-467
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDA

SEQ ID NO: 48 - protein, 448 aa, Homo sapiens
  sHuPH20 mature 36-483
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYN

SEQ ID NO: 49 - DNA, 1446 bp, Homo sapiens
  DNA encoding soluble rHuPH20 "precursor"
atgggagtgctaaaattcaagcacatctttttcagaagctttgttaaatcaagtggagtatcccagatagttttcaccttccttctgattccatgttgcttgactctgaatttcagagcacctcctgttattccaaatgtgcctttcctctgggcctggaatgccccaagtgaattttgtcttggaaaatttgatgagccactagatatgagcctcttctctttcataggaagcccccgaataaacgccaccgggcaaggtgttacaatattttatgttgatagacttggctactatccttacatagattcaatcacaggagtaactgtgaatggaggaatcccccagaagatttccttacaagaccatctggacaaagctaagaaagacattacattttatatgccagtagacaatttgggaatggctgttattgactgggaagaatggagacccacttgggcaagaaactggaaacctaaagatgtttacaagaataggtctattgaattggttcagcaacaaaatgtacaacttagtctcacagaggccactgagaaagcaaaacaagaatttgaaaaggcagggaaggatttcctggtagagactataaaattgggaaaattacttcggccaaatcacttgtggggttattatctttttccggattgttacaaccatcactataagaaacccggttacaatggaagttgcttcaatgtagaaataaaaagaaatgatgatctcagctggttgtggaatgaaagcactgctctttacccatccatttatttgaacactcagcagtctcctgtagctgctacactctatgtgcgcaatcgagttcgggaagccatcagagtttccaaaatacctgatgcaaaaagtccacttccggtttttgcatatacccgcatagtttttactgatcaagttttgaaattcctttctcaagatgaacttgtgtatacatttggcgaaactgttgctctgggtgcttctggaattgtaatatggggaaccctcagtataatgcgaagtatgaaatcttgcttgctcctagacaattacatggagactatactgaatccttacataatcaacgtcacactagcagccaaaatgtgtagccaagtgctttgccaggagcaaggagtgtgtataaggaaaaactggaattcaagtgactatcttcacctcaacccagataattttgctattcaacttgagaaaggtggaaagttcacagtacgtggaaaaccgacacttgaagacctggagcaattttctgaaaaattttattgcagctgttatagcaccttgagttgtaaggagaaagctgatgtaaaagacactgatgctgttgatgtgtgtattgctgatggtgtctgtatagatgcttttctaaaacctcccatggagacagaagaacctcaaattttctac

SEQ ID NO: 50 - protein, 509 aa, Homo sapiens
  PH20 variant P48A
MGVLKFKHIFFRSFVKSSGVSQIVFTFLLIPCCLTLNFRAPPVIPNVAFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVASL

SEQ ID NO: 51 - protein, 509 aa, Homo sapiens
  precursor PH20 variant L499W
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSIWFLIISSVASL

SEQ ID NO: 52 - DNA, 6630 bp, Artificial Sequence
  HZ24 vector
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggctagcatgggagtgctaaaattcaagcacatctttttcagaagctttgttaaatcaagtggagtatcccagatagttttcaccttccttctgattccatgttgcttgactctgaatttcagagcacctcctgttattccaaatgtgcctttcctctgggcctggaatgccccaagtgaattttgtcttggaaaatttgatgagccactagatatgagcctcttctctttcataggaagcccccgaataaacgccaccgggcaaggtgttacaatattttatgttgatagacttggctactatccttacatagattcaatcacaggagtaactgtgaatggaggaatcccccagaagatttccttacaagaccatctggacaaagctaagaaagacattacattttatatgccagtagacaatttgggaatggctgttattgactgggaagaatggagacccacttgggcaagaaactggaaacctaaagatgtttacaagaataggtctattgaattggttcagcaacaaaatgtacaacttagtctcacagaggccactgagaaagcaaaacaagaatttgaaaaggcagggaaggatttcctggtagagactataaaattgggaaaattacttcggccaaatcacttgtggggttattatctttttccggattgttacaaccatcactataagaaacccggttacaatggaagttgcttcaatgtagaaataaaaagaaatgatgatctcagctggttgtggaatgaaagcactgctctttacccatccatttatttgaacactcagcagtctcctgtagctgctacactctatgtgcgcaatcgagttcgggaagccatcagagtttccaaaatacctgatgcaaaaagtccacttccggtttttgcatatacccgcatagtttttactgatcaagttttgaaattcctttctcaagatgaacttgtgtatacatttggcgaaactgttgctctgggtgcttctggaattgtaatatggggaaccctcagtataatgcgaagtatgaaatcttgcttgctcctagacaattacatggagactatactgaatccttacataatcaacgtcacactagcagccaaaatgtgtagccaagtgctttgccaggagcaaggagtgtgtataaggaaaaactggaattcaagtgactatcttcacctcaacccagataattttgctattcaacttgagaaaggtggaaagttcacagtacgtggaaaaccgacacttgaagacctggagcaattttctgaaaaattttattgcagctgttatagcaccttgagttgtaaggagaaagctgatgtaaaagacactgatgctgttgatgtgtgtattgctgatggtgtctgtatagatgcttttctaaaacctcccatggagacagaagaacctcaaattttctactgaggatccatagctaacgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaaacgtctaggccccccgaaccacggggacgtggttttcctttgaaaaacacgatgataagcttgccacaacccacagcggccgctgccatcatggttcgaccattgaactgcatcgtcgccgtgtcccaaaatatggggattggcaagaacggagacctaccctggcctccgctcaggaacgagttcaagtacttccaaagaatgaccacaacctcttcagtggaaggtaaacagaatctggtgattatgggtaggaaaacctggttctccattcctgagaagaatcgacctttaaaggacagaattaatatagttctcagtagagaactcaaagaaccaccacgaggagctcattttcttgccaaaagtttggatgatgccttaagacttattgaacaaccggaattggcaagtaaagtagacatggtttggatagtcggaggcagttctgtttaccaggaagccatgaatcaaccaggccacctcagactctttgtgacaaggatcatgcaggaatttgaaagtgacacgtttttcccagaaattgatttggggaaatataaacttctcccagaatacccaggcgtcctctctgaggtccaggaggaaaaaggcatcaagtataagtttgaagtctacgagaagaaagactaaacgcgtggtacctctagagtcgacccgggcggccgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatcgataaggatccgggctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgacagatct

SEQ ID NO: 53 - protein, 186 aa, Mus musculus
  dihydrofolate reductase
VRPLNCIVAVSQNMGIGKNGDLPWPPLRNEFKYFQRMTTTSSVEGKQNLVIMGRKTWFSIPEKNRPLKDRINIVLSRELKEPPRGAHFLAKSLDDALRLIEQPELASKVDMVWIVGGSSVYQEAMNQPGHLRLFVTRIMQEFESDTFFPEIDLGKYKLLPEYPGVLSEVQEEKGIKYKFEVYEKKD

SEQ ID NO: 54 - protein, 6 aa, Artificial Sequence
  His tag
HHHHHH

SEQ ID NO: 55 - protein, 8 aa, Artificial Sequence
  Flag tag
DYKDDDDK

SEQ ID NO: 56 - DNA, 1449 bp, Homo sapiens
  Gen2 mRNA sequence
atgggagtgctaaaattcaagcacatctttttcagaagctttgttaaatcaagtggagtatcccagatagttttcaccttccttctgattccatgttgcttgactctgaatttcagagcacctcctgttattccaaatgtgcctttcctctgggcctggaatgccccaagtgaattttgtcttggaaaatttgatgagccactagatatgagcctcttctctttcataggaagcccccgaataaacgccaccgggcaaggtgttacaatattttatgttgatagacttggctactatccttacatagattcaatcacaggagtaactgtgaatggaggaatcccccagaagatttccttacaagaccatctggacaaagctaagaaagacattacattttatatgccagtagacaatttgggaatggctgttattgactgggaagaatggagacccacttgggcaagaaactggaaacctaaagatgtttacaagaataggtctattgaattggttcagcaacaaaatgtacaacttagtctcacagaggccactgagaaagcaaaacaagaatttgaaaaggcagggaaggatttcctggtagagactataaaattgggaaaattacttcggccaaatcacttgtggggttattatctttttccggattgttacaaccatcactataagaaacccggttacaatggaagttgcttcaatgtagaaataaaaagaaatgatgatctcagctggttgtggaatgaaagcactgctctttacccatccatttatttgaacactcagcagtctcctgtagctgctacactctatgtgcgcaatcgagttcgggaagccatcagagtttccaaaatacctgatgcaaaaagtccacttccggtttttgcatatacccgcatagtttttactgatcaagttttgaaattcctttctcaagatgaacttgtgtatacatttggcgaaactgttgctctgggtgcttctggaattgtaatatggggaaccctcagtataatgcgaagtatgaaatcttgcttgctcctagacaattacatggagactatactgaatccttacataatcaacgtcacactagcagccaaaatgtgtagtcaagtgctttgccaggagcaaggagtgtgtataaggaaaaactggaattcaagtgactatcttcacctcaacccagataattttgctattcaacttgagaaaggtggaaagttcacagtacgtggaaaaccgacacttgaagacctggagcaattttctgaaaaattttattgcagctgttatagcaccttgagttgtaaggagaaagctgatgtaaaagacactgatgctgttgatgtgtgtattgctgatggtgtctgtatagatgcttttctaaaacctcccatggagacagaagaacctcaaattttctactga

SEQ ID NO: 57 - protein, 17 aa, Homo sapiens
  C-terminal peptide cleaved from soluble rHuPH20 aa 431-447
DAFKLPPMETEEPQIFY

SEQ ID NO: 58 - protein, 16 aa, Homo sapiens
  C-terminal peptide cleaved from soluble rHuPH20 aa 431-446
DAFKLPPMETEEPQIF

SEQ ID NO: 59 - protein, 15 aa, Homo sapiens
  C-terminal peptide cleaved from soluble rHuPH20 aa 431-445
DAFKLPPMETEEPQI

SEQ ID NO: 60 - protein, 14 aa, Homo sapiens
  C-terminal peptide cleaved from soluble rHuPH20 aa 431-444
DAFKLPPMETEEPQ

SEQ ID NO: 61 - protein, 13 aa, Homo sapiens
  C-terminal peptide cleaved from soluble rHuPH20 aa 431-443
DAFKLPPMETEEP

SEQ ID NO: 62 - protein, 12 aa, Homo sapiens
  C-terminal peptide cleaved from soluble rHuPH20 aa 431-442
DAFKLPPMETEE

SEQ ID NO: 63 - protein, 520 aa, Ovis aries
  PH20
LDFPAPPLISNTSFLWAWNAPAERCVKIFKLPPDLRLFSVKGSPQKSATGQFITLFYADRLGYYPHIDEKTGNTVYGGIPQLGNLKNHLEKAKKDIAYYIPNDSVGLAVIDWENWRPTWARNWKPKDVYRDESVELVLQKNPQLSFPEASKIAKVDFETAGKSFMQETLKLGKLLRPNHLWGYYLFPDCYNHNYNQPTYNGNCSDLEKRRNDDLDWLWKESTALFPSVYLNIKLKSTPKAAFYVRNRVQEAIRLSKIASVESPLPVFVYHRPVFTDGSSTYLSQGDLVNSVGEIVALGASGIIMWGSLNLSLTMQSCMNLGNYNTTLNPYIINVTLAAKMCSQVLCHDEGVCTRKQWNSSDYLHLNPIMNFAIQTGKGGKYTVPGKVTLEDLQTFSDKFYCSCYANINCKKRVDIKNVHSVNVCMAEDICIEGPVKLQPSDHSSSQNEASTTTVSSISPSTTATTVVSPCTPEKQSPECLKVRCLEAIANVTQTGCQGVKWKNTSSQSQSSIQNIKNQTT

SEQ ID NO: 64 - protein, 474 aa, Bos taurus
  PH20
MGMFRRHHISFRSFAGSSGTPQAVFTFLLLPCCLALDFRAPPLISNTSFLWAWNAPVERCVNRRFQLPPDLRLFSVKGSPQKSATGQFITLFYADRLGYYPHIDEKTGKTVFGGIPQLGNLKSHLEKAKNDIAYYIPNDSVGLAVIDWENWRPTWARNWKPKDVYRDESVELVLQKNPQLSFPEASKIAKVDFETAGKSFMQETLKLGKLLRPNHLWGYYLFPDCYNHNHNQPTYNGNCPDVEKRRNDDLEWLWKESTALFPSVYLNIRLKSTQNAALYVRNRVQEAIRLSKIASVESPLPVFVYARPVFTDGSSTYLSQGDLVNSVGEIVSLGASGIIMWGSLNLSLSVQSCMNLGTYLNTTLNPYIINVTLAAKMCSQVLCHDGGVCTRKHWNSSDYLHLNPMNFAIQTGEGGKYTVPGTLTLEDLQKFSDTFYCSCYSNLSCKKRVDIKNVHSVDVCMAEDVCIDAFLKPP

SEQ ID NO: 65 - protein, 517 aa, Ovis aries
  PH20
DFRAPPLISNTSFLWAWNAPAERCIKIFKLPPDLRLFSVKGSPQKSATGQFITLFYADRLGYYPHIDEKTGNTVYGGIPQLGNLKNHLEKAKKDIAYYIPNDSVGLAVIDWENWRPTWARNWKPKDVYRDESVELVLQKNPQLSFPEASKIAKVDFETAGKSFMQETLKLGKLLRPNHLWGYYLFPDCYNHNYNQPTYNGNCSDLEKRRNDDLDWLWKESTALFPSVYLNIKLKSTPKAAFYVRNRVQEAIRLSKIASVESPLPVFVYHRPVFTDGSSTYLSQGDLVNSVGEIVALGASGIIMWGSLNLSLTMQSCMNLGNYLNTTLNPYIINVTLAAKMCSQVLCHDEGVCTRKQWNSSDYLHLNPMNFAIQTGKGGKYTVPGKVTLEDLQTFSDKFYCSCYANINCKKRVDIKNVHSVNVCMAEDICIEGPVKLQPSDHSSSQNEASTTTVSSISPSTTATTVSPCTPEKQSPECLKVRCLEAIANVTQTGCQGVKWKNTSSQSSIQNIKNQTTY

SEQ ID NO: 66 - DNA, 1620 bp, Ovis aries
  encoding sheep PH20
ttttccgtgttggttggctctggacttcagagcaccccctctcatttcaaacacttctttcctctgggcctggaatgccccagctgaacgttgtattaaaatctttaaactacctccagatctgagactcttctctgtaaaaggaagcccccaaaaaagtgctacgggacaatttattacattattttatgctgatagacttggctactatcctcatatagatgaaaaaacaggcaacactgtatatggaggaattccccagttgggaaacttaaaaaatcatttggaaaaagccaaaaaagacattgcctattacataccaaatgacagcgtgggcttggcggtcattgactgggaaaactggaggcctacctgggcaagaaactggaaacctaaagatgtttacagggatgagtctgttgagttggttctgcaaaaaaatccacaactcagtttcccagaggcttccaagattgcaaaagtggattttgagacagcaggaaagagtttcatgcaagagactttaaaactgggaaaattacttcggccaaatcacttatggggttattatctttttcctgattgttacaatcataattataaccagcctacttacaatggaaattgctctgatttagaaaaaaggagaaatgatgatctcgactggttgtggaaggaaagcactgcccttttcccttctgtttatttgaatatcaagttaaaatctactccaaaagctgccttctatgttcgtaatcgtgtccaggaagccattcggttgtctaaaatagcgagtgttgaaagtccacttcccgtttttgtatatcaccgtccagtttttactgatgggtcttcaacatacctttctcagggtgaccttgtgaattcggttggtgagatcgttgctctaggtgcctctgggattataatgtggggcagtctcaatctaagcctaactatgcaatcttgcatgaacctaggcaattacttgaacactacactgaatccttacataatcaacgtcaccctagcagccaaaatgtgcagccaagtgctttgccacgatgaaggagtgtgtacaaggaaacaatggaattcaagcgactatcttcacctgaacccaatgaattttgctattcaaactgggaaaggtggaaaatacacagtacctgggaaagtcacacttgaagacctgcaaacgttttctgataaattttattgcagttgttatgccaacatcaactgtaagaagagagttgatataaaaaatgttcatagtgttaatgtatgtatggcagaagacatttgtatagagggccctgtgaagttacaacccagtgatcattcctctagccagaatgaggcatctactaccaccgtcagcagtatctcaccctctactacagccaccacagtatctccatgtactcctgagaaacagtcccctgagtgcctcaaagtcaggtgtttggaagccatcgccaacgtcacccaaacggggtgtcaaggtgttaaatggaagaacacttccagtcagtcaagtattcaaaatattaaaaatcaaacaacctattaaaatataaattcagtgcttataaaaaaaaaaaaaaaaaaaaaaaa

SEQ ID NO: 67 - protein, 793 aa, Arthrobacter sp.
  hyaluronan lyase (strain FB24)
MTREFSRRTALKGAALSGLLLAMVHGPAHAAATANATLTPADFAGLRQRWVDQITGRKVLVAGDNDFVTALAALDKKARTAIDLLERSAGRLTVFSDLSLAKDTDLVTTHTRLATMATAWATPGSEHFADAGLLAAIRAGLADANSLCYNASKEEQGNWWSWEIGTPKALADTMVLLHAELTAAERAAYCAAIDHFVPDPWQQFPPKRGKITSVGANRVDLCQAVTIRSLVDEDAEKLTHAVAGLSEVWQYVSAGNGFFTDGSFIQHSTTPYTGSYGVVLLTGLSKLFALLGGTGAEVSDPSRDILFKTVEGSFAPFMVAGAMADSVRGRSISRESNTGFDLGASTIESILLLARAVDPVTARRWRSLCLAWINQNRKAPILADAGVGRTALVKELLAMGLTETDLPGGHYLFPAMDRTMHHSQGWTLSTAMASSRIAWYECGNGENNRGYHTGSGMTYVYDGDLGQYDDAFWATANHCRLPGITVDTSSLPDKVEGEWGAATPANEWTGSTAYGDVAAVGQHLIGPGGTGLTARKSWFVSKDVIVCLGADIRTGSGSRIETVVDHRNLHAGFNAMGTAAGTVAATPGHPEVLTVDRWVHLEGFGGYVVLDAAPLQVLREQREGSWSEVNVKGSAARQTRNYATLYFDHGHEPEAASYAYLVAPGASASMTSSLSGQSFHTVLRNDEVAQAVKFKKEKTTAATFWRPGTVGDLALSGPACVVVKEVGDRLSIAVSDPTQNASTLTLRLKTKRFFRIIEGQGASLSHGADGFTVLEVDIANHAGRTKQIELSAE

SEQ ID NO: 68 - protein, 557 aa, Bdellovibrio bacteriovorus
  hyaluronan lyase
MTKFFFLLTLISATAFAQSEPDWTAGVPVPPGGRSNIYSWNDFDFQATLNKGKIHAQVYPVTVTGMLPPYEPVRRLIEEKNSNPLRKWIQSLMKGLSGFRSFEDVLKNLGLHKYPLENERGVYAVPYPNEIRPDTLMGFGLIERNGAEGFTFSCAACHSSNLFGKTVLGMTNRFPRANEFFIKAKKVMPLMDPHIFQAYTRATDAETALLVESKERLKSVALKQPIALGLDTSLAQVSLSLNRRAKDGYANYSDKAARSPRADAYLDNKPADSKPAVWWNVKYKNRWLSDGSVLSGNPIFTNLIWNEIGRGADLHELEQWLADNDHIIKELTTAVFASEAPHITDFYPAEKIDLGRAKAGEQIFKNTCAKCHGHYEKAWNLPQALVLSAAERLKTVEVRYKEKTPVVNVGTDPFRRQGMKSLEQLNDLEISKKNGIVIKAQEGYVPPPLVGIWARWPYMHNNSIPNLCVLLTPAKKRPSIYYSGEALNKDTDYDFSCGGYPIGDKTPKAWKTREHLYDTRNPGMGNMGHDEGIFIKDGKEILSAEDKYNLIQFLQTL

SEQ ID NO: 69 - protein, 813 aa, Propionibacterium acnes
  hyaluronan lyase
MFGTPSRRTFLTASALSAMALAASPTVTDAIAAPGPDSWSALCERWIDIITGRRAARTSDPRARAIIAKTDRKVAEILTDLVSGSSRQTVLISADLRKEQSPFITKTARAIESMACAWATPGSSYHKDPEILSACIEGLRDFCRLRYNPSQDEYGNWWDWEDGASRAVADVMCILHDVLPPEVMSAAAAGIDHFIPDPWFQQPASVKPTANPVQPVVSTGANRMDLTRAVMCRSIATGDEKRLRHAVDGLPDAWRVTTEGDGFRADGGFIQHSHIPYTGGYGDVLFSGLAMLFPLVSGMRFDIVESARKAFHDQVERGFIPVMYNGQILDDVRGRSISRINESAAMHGISIARAMLMMADALPTHRAEQWRGIVHGWMARNTFDHLSEPSTLVDISLFDAAAKARPVPESSTPSYFASMDRLVHRTADWLITVSNCSDRIAWYEYGNGENEWASRTSQGMRYLLLPGDMGQYEDGYWATVDYSAPTGTTVDSTPLKRAVGASWAAKTPTNEWSGGLASGSWSAAASHITSQDSALKARRLWVGLKDAMVELTTDVTTDASRAITVVEHRKVASSSTKLLVDGNRVSSATSFQNPRWAHLDGVGGYVFATDTDLSADVATRKGTWIDVNPSRKVKGADEVIERAYASLHVTHHDRPVAWALLPTASRSHTMALATRPGVEPFTVLRNDATVQAVRSAGALLTKDPTVVTTLAFWKPATCGGVAVNRPALVQTRESANQMEVVIVEPTQKRGSLTVTIEGSWKVKTADSHVDVSCENAAGTLHVDTAGLGGQSVRVTLARQVTQTPSGGGRHDRA

SEQ ID NO: 70 - protein, 1072 aa, Streptococcus agalactiae
  hyaluronan lyase
MEIKKKYRIMLYSALILGTILVNNSYQAKAEELTKTTSTSQIRDTQTNNIEVLQTESTTVKETSTTTTQQDLSNPTASTATATATHSTMKQVVDNQTQNKELVKNGDFNQTNPVSGSWSHTSAREWSAWIDKENTADKSPIIQRTEQGQVSLSSDKGFRGAVTQKVNIDPTKKYEVKFDIETSNKAGQAFLRIMEKKDNNTRLWLSEMTSGTTNKHTLTKIYNPKLNVSEVTLELYYEKGTGSATFDNISMKAKGPKDSEHPQPVTTQIEESVNTALNKNYVFNKADYQYTLTNPSLGKIVGGILYPNATGSTTVKISDKSGKIIKEVPLSVTASTEDKFTKLLDKWNDVTIGNHVYDTNDSNMQKINQKLDETNAKNIKTIKLDSNHTFLWKDLDNLNNSAQLTATYRRLEDLAKQITNPHSTIYKNEKAIRTVKESLAWLHQNFYNVNKDIEGSANWWDFEIGVPRSITATLALMNNYFTDAEIKTYTDPIEHFVPDAGYFRKTLDNPFKALGGNLVDMGRVKIIEGLLRKDNTIIEKTSHSLKNLFTTATKAEGFYADGSYIDHTNVAYTGAYGNVLIDGLTQLLPIIQETDYKISNQELDMVYKWINQSFLPLIVKGELMDMSRGRSISREAASSHAAAVEVLRGFLRLANMSNEERNLDLKSTIKTIITSNKFYNVFNNLKSYSDIANMNKMLNDSTVATKPLKSNLSTFNSMDRLAYYNAEKDFGFALSLHSKRTLNYEGMNDENTRGWYTGDGMFYLYNSDQSHYSNHFWPTVNPYKMAGTTEKDAKREDTTKEFMSKHSKDAKEKTGQVTGTSDFVGSVKLNDHFALAAMDFTNWDRTLTAQKGWVILNDKIVFLGSNIKNTNGIGNVSTTIDQRKDDSKTPYTTYVNGKTIDLKQASSQQFTDTKSVFLESKEPGRNIGYIFFKNSTIDIERKEQTGTWNSINRTSKNTSIVSNPFITISQKHDNKGDSYGYMMVPNIDRTSFDKLANSKEVELLENSSKQQVIYDKNSQTWAVIKHDNQESLINNQFKMNKAGLYLVQKVGNDYQNVYYQPQTMTKTDQLAI

SEQ ID NO: 71 - protein, 1072 aa, Streptococcus agalactiae 18RS21
  hyaluronan lyase
MEIKKKHRIMLYSALILGTILVNNSYQAKAEELTKTTSTSQIRDTQTNNIEVLQTESTTVKETSTTTTQQDLSNPTASTATATATHSTMKQVVDNQTQNKELVKNGDFNQTNPVSGSWSHTSAREWSAWIDKENTADKSPIIQRTEQGQVSLSSDKGFRGAVTQKVNIDPTKKYEVKFDIETSNKAGQAFLRIMEKKDNNTRLWLSEMTSGTTNKHTLTKIYNPKLNVSEVTLELYYEKGTGSATFDNISMKAKGPKDSEHPQPVTTQIEESVNTALNKNYVFNKADYQYTLTNPSLGKIVGGILYPNATGSTTVKISDKSGKIIKEVPLSVTASTEDKFTKLLDKWNDVTIGNHVYDTNDSNMQKINQKLDETNAKNIKTIKLDSNHTFLWKDLDNLNNSAQLTATYRRLEDLAKQITNPHSTIYKNEKAIRTVKESLAWLHQNFYNVNKDIEGSANWWDFEIGVPRSITATLALMNNYFTDAEIKTYTDPIEHFVPDAGYFRKTLDNPFKALGGNLVDMGRVKIIEGLLRKDNTIIEKTSHSLKNLFTTATKAEGFYADGSYIDHTNVAYTGAYGNVLIDGLTQLLPIIQETDYKISNQELDMVYKWINQSFLPLIVKGELMDMSRGRSISREAASSHAAAVEVLRGFLRLANMSNEERNLDLISTIKTIITSNKFYNVFNNLKSYSDIANMNKMLNDSTVATKPLKSNLSTFNSMDRLAYYNAEKDFGFALSLHSKRTLNYEGMNDENTRGWYTGDGMFYLYNSDQSHYSNHFWPTVNPYKMAGTTEKDAKREDTTKEFMSKHSKDAKEKTGQVTGTSDFVGSVKLNDHFALAAMDFTNWDRTLTAQKGWVILNDKIVFLGSNIKNTNGIGNVSTTIDQRKDDSKTPYTTYVNGKTIDLKQASSQQFTDTKSVFLESKEPGRNIGYIFFKNSTIDIERKEQTGTWNSINRTSKNTSIVSNPFITISQKHDNKGDSYGYMMVPNIDRTSFDKLANSKEVELLENSSKQQVIYDKNSQTWAVIKHDNQESLINNQFKMNKAGLYLVQKVGNDYQNVYYQPQTMTKTDQLAI

SEQ ID NO: 72 - protein, 1081 aa, Streptococcus agalactiae serotype Ia
  hyaluronan lyase
MEIKKKHRIMLYSALILGTILVNNSYQAKAEEFTKTTSTSQIRDTQTNNVEVPQTESTTVKGTSTTTTQQDLSNSTASTATATATHSTMKQVVDNQTQNKELVKNGDFKEKIIDKKIDKKSQWTNLYGAKDWNTYIDQTKSVNKSPIIQRTEQGQVSLSSDKGFRGAVTQKVNIDPTKKYEVKFDIETSNKVGQAFLRIMKKKDKNTRLWLSEMTSGTTNKHTLTKIYNPKLNVSEVTLELYYEKGTGSVTFDNISMKAKGPKDSEHPQPVTTQIEESVNTALNKNYVFNKADYQYTLTNPSLGKIVGGILYPSATGSTTVKISDKSGKIIKEVPLSVTASTEDNFTKLLDKWNDVTIGNHVYDTNDSNMQKLNQKLDETNAKNIKDIKLDSNRTFLWEDLKGLNNSAQLTATYRRLEDLAKQITNPHSTIYKNEKAIRTVKESLAWLHQNFYNVNKDIEGSANWWDFEIGVPRSITATLALMNNYFTDAEIKTYTDPIEHFVPDAGYFRKTLVNPFKALGGNLVDMGRVKIIEGLLRKDNTIIKKTSHSLKNLFTTATKAEGFYADGSYIDHTNVAYTGAYGNVLIDGLTQLLPIIQETDYKISNQELDMVYKWINQSFLPLIVKGELMDMSRGRSISREAASSHAAAVEVLRGFLRLANMSNEERNLDLKSTIKTIITSNKFYNVFNNLKSYSDIANMNKLLNDSTVATKPLKSNLSTFNSMDRLAYYNAEKDFGFALSLHSKRTLNYEGMNDENTRGWYTGDGMFYLYNSDQSHYSNHFWPTVNPYKMAGTTEKDTGREDTIKKLMNRYDKTNKNSKVMTGQVTGTSDFVGSVKLNDHFALAAMDFTNWDRTLTAQKGWVILNDKIVFLGSNIKNTNGVGNVSTTIDQRKDDSKTPYTTYVNGKTVDLKQASSQQFTDTKSVFLESKEPGRNIGYIFFKNSTIDIERKEQTGTWNSINRTSKNTSIVSNPFITISQKHDNKGDSYGYMMVPNIDRTSFDKLANSKEVELLENSSKQQVIYDKNSQTWAVIKHDNQESLINNQFKMNKAGLYLVQKVGNDYQNVYYQPQTMTKTDQLAI

SEQ ID NO: 73 - protein, 984 aa, Streptococcus agalactiae serotype III
  hyaluronan lyase
MKQVVDNQTQNKELVKNGDFNQTNPVSGSWSHTSAREWSAWIDKENTADKSPIIQRTEQGQVSLSSDKGFRGAVTQKVNIDPTKKYEVKFDIETSNKAGQAFLRIMEKKDNNTRLWLSEMTSGTTNKHTLTKIYNPKLNVSEVTLELYYEKGTGSATFDNISMKAKGPKDSEHPQPVTTQIEESVNTALNKNYVFNKADYQYTLTNPSLGKIVGGILYPNATGSTTVKISDKSGKIIKEVPLSVTASTEDKFTKLLDKWNDVTIGNHVYDTNDSNMQKINQKLDETNAKNIKTIKLDSNHTFLWKDLDNLNNSAQLTATYRRLEDLAKQITNPHSTIYKNEKAIRTVKESLAWLHQNFYNVNKDIEGSANWWDFEIGVPRSITATLALMNNYFTDAEIKTYTDPIEHFVPDAGYFRKTLDNPFKALGGNLVDMGRVKIIEGLLRKDNTIIEKTSHSLKNLFTTATKAEGFYADGSYIDHTNVAYTGAYGNVLIDGLTQLLPIIQETDYKISNQELDMVYKWINQSFLPLIVKGELMDMSRGRSISREAASSHAAAVEVLRGFLRLANMSNEERNLDLKSTIKTIITSNKFYNVFNNLKSYSDIANMNKMLNDSTVATKPLKSNLSTFNSMDRLAYYNAEKDFGFALSLHSKRTLNYEGMNDENTRDWYTGDGMFYLYNSDQSHYSNHFWPTVNPYKMAGTTEKDAKREDTTKEFMSKHSKDAKEKTGQVTGTSDFVGSVKLNDHFALAAMDFTNWDRTLTAQKGWVILNDKIVFLGSNIKNTNGIGNVSTTIDQRKDDSKTPYTTYVNGKTIDLKQASSQQFTDTKSVFLESKEPGRNIGYIFFKNSTIDIERKEQTGTWNSINRTSKNTSIVSNPFITISQKHDNKGDSYGYMMVPNIDRTSFDKLANSKEVELLENSSKQQVIYDKNSQTWAVIKHDNQESLINNQFKMNKAGLYLVQKVGNDYQNVYYQPQTMTKTDQLAI

SEQ ID NO: 74 - protein, 807 aa, Staphylococcus aureus (strain COL); identical to SEQ ID NO: 33
  hyaluronan lyase

SEQ ID NO: 75 - protein, 420 aa, Staphylococcus aureus (strain MRSA252)
  hyaluronan lyase
MTYRMKKWQKLSTITLLMAGVITLNGGEFRSIDKHQIAVADTNVQTTDYEKLRNIWLDVNYGYDKYDENNPDMKKKFEATENEAEKLLKEMKTESDRKYLWESSKDLDTKSADMTRTYRNIEKISEAMKHKNTKLKTDENKTKVKDALEWLHKNAYGKEPDKKVADLTSNFKNKTSRNTNLNWWDYEIGTPRALTNTLILLQEDFTDEEKKKYTAPIKTFAPDSDKILSSVGKSEPAKGGNLVDISKVKLLESIIEEDKDMMKKSIDSFNTVFTYAQNSATGKERNGFYKDGSYIDHQDVPYTGAYGVVLLEGISQMMPMIKETPFNDSNQNDTTLKSWIDDGFMPLIYKGEMMDLSRGRAISRENETSHSASATVMKSLLRLSDTMDKSTKAKYKKIVKTSVESDSSYKQTDYLSSYSD

SEQ ID NO: 76 - protein, 806 aa, Staphylococcus aureus (strain MRSA252)
  hyaluronan lyase
MTNKMKKWQKLSTITLLMTGVIALNNGEFRNVDKHQIAVADTNVQTPDYEKLKKTWLDVNYGYDQYDENNQDMKKKFDAKEKEAKKLLDDMKTDTNRTYLWSGAENLETNSSHMTKTYRNIEKIAESMQHKNTVLKTVENKLKIKEALDWMHKNVYGKNPSQKVEDLTKNRKGQTTPKNNSLNWWDYEIGTPRALTNTLLLMDDMLTKDEMKNYSKPISTYAPSSDKILSSVGESEDAKGGNLVDISKVKLLESVIEEDVDMLKKSIDSFNKVFTYVQDSATGKGRNGFYKDGSYIDHQDVPYTGAYGVVLLEGISQMMPMIKESPFKTTQDNATLSNWIDEGFMPLIYKGEMMDLSRGRAISRENETSHTASATVMKSLLRLNDTMDDSTKTRYKQIVKTSVNSDSSYNQNNYLNSYSDIAKMKKLMNDSTISKNDLTQQLKIYNDMDRVTYHNKDLDFAFGLSMTSKNIARYENINGENLKGWHTGAGMSYLYNSDVKHYRDNFWATADMTCLPGTTTLNDMPSTNTKNDKSFVGGTKLNNKYASIGMDFENQDKTLTAKKSYFILNDKIVFLGTGIKSTDSSKNPVTSVENRKANGYKLFKDDIEITTSDVNAQETHSVFLESNDTKKNIGYHFLDKPKITVKKESHTGKWSEINKSQKKDDKKDEYYEVTQTHNTSDSKYAYVLYPGLSKSDFKSKNNNVSIVKQDEDFHVIKDNDGVFAGVNYSDNTKSFDINGITVELKEKGMFVIKKKDDKAYKCSFYNPETTNTASNIESKIFIKGYTITNKSVINSNDAGVNFELTK

SEQ ID NO: 77 - protein, 815 aa, Staphylococcus aureus (strain MSSA476)
  hyaluronan lyase
MTYRIKKWQKLSTITLLMAGVITLNGGEFRSIDKYQIAVADTNVQTPDYEKLRNTWLDVNYGYDKYDEKNDAMKKKFEATENEAKKLLSEMKTESDRKYLWENSKDLDTKSADMTRTYRNIEKIAEAMKHKDTKLKIDENKKKVKDALEWLHKNAYGKEPDKKVADLTSNFKNKTSRNTNLNWWDYEIGTPRALTNTLILLNDQFSNDEKKKYTAPIKTFAPESDKILSSVGQPEQAKGGNLVDIAKVKLLESIIEEDKDITKNSIDAFNKVFTYVQSNATGKERNGFYKDGSYIDHQDVPYTGAYGVVLLEGISQMMPMIKETPFNDKTQNDTTLKSWIDDGFMPLIYKGEMMDLSRGRAISRENETSHTASATVMKSLLRLSDAMDDSTKAKYKQIVKTSVKSDSSYGQNDTLSSYSDISKMKSLMEDSTISTNGLTQQLKIYNDMDRVTYHNKDLDFAFGLSMTSKNVARYESINGENLKGWHTGAGMSYLYNSDVKHYRDNFWATADMKRLAGTTTLENEEPKGTDVKKSSKTFVGGTKFDDQHASIGMDFENQDKTLTAKKSYFILNDKIVFLGTGIKSTDSSKNPVTTIENRKANGYTLYTDDKQTTASDNQGTNSVFLESTNKPKNNIGYHFLNESKITVKKESHTGKWSDINKSQKQDSKTNQYYEVTQKHSNTDSKYAYVLYPGLSKDDFNTKKDKVTVVKQDDDFHVVKDNESVWAGVNYSDSTQTFIINNTKVEVKAKGMFILKKKDDKTYECSFYNPESTNTASDIESKISMTGYSITNKNTSTSNESGVRFELQQTLNKDDN

SEQ ID NO: 78 - protein, 807 aa, Staphylococcus aureus (strain NCTC 8325); identical to SEQ ID NO: 33
  hyaluronan lyase

SEQ ID NO: 79 - protein, 809 aa, Staphylococcus aureus (strain bovine RF122)
  hyaluronan lyase
MTYRMKKWQKLSTITLLMAGGITFNDSEFRSVDKHQIAVADTNVQTPNYEKLKNTWLDVNYGYDKYDESNPDMKKKFEATEKEARKLLSEMKTESDRKYLWENSKDLDTKSADMTRTYRNIEKIAEAMKHPKTTLKNDENKKKVKDALEWLHKNAYGKEPGKKVADLKTNFSKSAPQKNTNLNWWDYEIGTPRALTNTLILLKEDFTDEEKKKYTAPIKTFAPKSDEILSSVGKAEPAKGGNLVDISKVKLLESIIEEDKDMMKNSIDSFNKVFTYVQDSATDKERNGFYKDGSYIDHKDVPYTGAYGVVLLEGISQMMPMIKETPFNDKTQNNTTLTSWIDDGFMPLIYKGEMMDLSRGRAISRENETSHSASATVMKSLLRLSDAMDESTKAKYKQIVKNSVKSDSSYGQNDTLSSYSDIDKMKSLMTDSTISTNGLTQQLKIYNAMDRVTYHNKDLDFAFGLSMTSKNVARYENINGENLKGWHTGAGMSYLYNSDVRHYRDNFWATADMKRLADTTTLENEEPKGTDVKKSSKTFVGGTKFDDQHASIGMDFENQDKTLTAKKSYFILNDKIVFLGTGIKTTDSSKNPVTTIENRKAHGYTLYTDDKQTTNSNNQETNSVFLESTNSTQNNIGYHFLNKSKITVKKESHTGKWSDINKSQKDTQKTDEYYEVTQKHSNTDDKYAYVLYPGITKDNFKSKASQVTVVKQDDDFHVVKDNESVWAGVNYSDSTQTFDINGTKVEVKAKGMFILKKKDDNTYECSFYNPESTNSASDIESKISMTGYSITNKNTSNTNESGVRFELTK

SEQ ID NO: 80 - protein, 807 aa, Staphylococcus aureus (strain bovine RF122)
  hyaluronan lyase
MTYKMKKWQKLSTITLLMAGVITLNNGEFRNVDKHQIAVADTNVQTPDYEKLKKTWLDVNYGNDQYDENNQDMKKKFDAKENEAKKLLEDMKTDTNRTYLWSGAENLETNSSHMTKTYRNIEKIAEAMRHKNTSLKTDENKLKIKDAIKWLHHNVYGKDPDKKVADLTTNRKEKDSSKKNNSLNWWDYEIGTPRALTNTLLLMDNMLTKDEMKNYSKPISIYSPSSYKILSSVGESEDAKGGNLVDIAKVKFLESVIEEDVDMMKKSIDSFNKVFTYVQDSATGKARNGFYKDGSYIDHQDVPYTGAYGVVLLEGISQMMPMIKESPFKHTQDKATLSNWIDEGFMPLIYKGEMMDLSRGRAISRENETSHTASATVMKSLLRLSDTMDESTKTKYKQIVKTSVKSDSSYDSNDTLNSYSDIDKMKKLMNDSTISKNDLTQQLKIYNDMDRVTYHNKELDFAFGLSMTSKNIARYENINGENLKGWHTGAGMSYLYNSDVKHYRDNFWATADMTRLPGTTTLNDMPSTNTKNDKSFVGGTKLNNKYASIGMDFENQDKTLTAKKSYFILNDKIVFIGTGIKSTDSSKNPVTSVENRKANGYKLFKGDIEITTSDVNAQETHSVFLESNDTKKNIGYHFLDKPKITVKKESHTGKWSEINKSQKTDDKKDEYYEVTQTHNTSDSKYAYVLYPGLSKSDFKSKNNNVSIVKQDEDFHVIKDNDGVFAGVNYSDSTKSFDINGTIVELKEKGMFVIKKKDDNTYECSFYNPTSTNSTSNKESKISVTGYTITNQSVSNFKESDIHFELTK

SEQ ID NO: 81 - protein, 807 aa, Staphylococcus aureus (strain USA300); identical to SEQ ID NO: 33
  hyaluronan lyase

SEQ ID NO: 82 - protein, 1066 aa, Streptococcus pneumoniae
  hyaluronan lyase
MQTKTKKLIVSLSSLVLSGFLLNHYMTIGAEETTTNTIQQSQKEVQYQQRDTKNLVENGDFGQTEDGSSPWTGSKAQGWSAWVDQKNSADASTRVIEAKDGAITISSHEKLRAALHRMVPIEAKKKYKLRFKIKTDNKIGIAKVRIIEESGKDKRLWNSATTSGTKDWQTIEADYSPTLDVDKIKLELFYETGTGTVSFKDIELVEVADQLSEDSQTDKQLEEKIDLPIGKKHVFSLADYTYKVENPDVASVKNGILEPLKEGTTNVIVSKDGKEVKKIPLKILASVKDAYTDRLDDWNGIIAGNQYYDSKNEQMAKLNQELEGKVADSLSSISSQADRTYLWEKFSNYKTSANLTATYRKLEEMAKQVTNPSSRYYQDETVVRTVRDSMEWMHKHVYNSEKSIVGNWWDYEIGTPRAINNTLSLMKEYFSDEEIKKYTDVIEKFVPDPEHFRKTTDNPFKALGGNLVDMGRVKVIAGLLRKDDQEISSTIRSIEQVFKLVDQGEGFYQDGSYIDHTNVAYTGAYGNVLIDGLSQLLPVIQKTKNPIDKDKMQTMYHWIDKSFAPLLVNGELMDMSRGRSISRANSEGHVAAVEVLRGIHRIADMSEGETKQCLQSLVKTIVQSDSYYDVFKNLKTYKDISLMQSLLSDAGVASVPRPSYLSAFNKMDKTAMYNAEKGFGFGLSLFSSRTLNYEHMNKENKRGWYTSDGMFYLYNGDLSHYSDGYWPTVNPYKMPGTTETDAKRADSDTGKVLPSAFVGTSKLDDANATATMDFTNWNQTLTAHKSWFMLKDKIAFLGSNIQNTSTDTAATTIDQRKLESGNPYKVYVNDKEASLTEQEKDYPETQSVFLESFDSKKNIGYFFFKKSSISMSKALQKGAWKDINEGQSDKEVENEFLTISQAHKQNRDSYGYMLIPNVDRATFNQMIKELESSLIENNETLQSVYDAKQGVWGIVKYDDSVSTISNQFQVLKRGVYTIRKEGDEYKIAYYNPETQESAPDQEVFKKLEQAAQPQVQNSKEKEKSEEEKNHSDQKNLPQTGEGQSILASLGFLLLGAFYLFRRGKNN

SEQ ID NO: 83 - protein, 1078 aa, Streptococcus pneumoniae (strain ATCC BAA-255/R6)
  hyaluronan lyase
MILQYVYWSVYMQTKTKKLIVSLSSLVLSGFLLNHYMTVGAEETTTNTIQQSQKEVQYQQRDTKNLVENGDFGQTEDGSSPWTGSKAQGWSAWVDQKNSSADASTRVIEAKDGAITISSPEKLRAAVHRMVPIEAKKKYKLRFKIKTDNKVGIAKVRIIEESGKDKRLWNSATTSGTKDWQTIEADYSPTLDVDKIKLELFYETGTGTVSFKDIELVEVADQPSEDSQTDKQLEEKIDLPIGKKHVFSLADYTYKVENPDVASVKNGILEPLKEGTTNVIVSKDGKEVKKIPLKILASVKDTYTDRLDDWNGIIAGNQYYDSKNEQMAKLNQELEGKVADSLSSISSQADRIYLWEKFSNYKTSANLTATYRKLEEMAKQVTNPSSRYYQDETVVRTVRDSMEWMHKHVYNSEKSIVGNWWDYEIGTPRAINNTLSLMKEYFSDEEIKKYTDVIEKFVPDPEHFRKTTDNPFKALGGNLVDMGRVKVIAGLLRKDDQEISSTIRSIEQVFKLVDQGEGFYQDGSYIDHTNVAYTGAYGNVLIDGLSQLLPVIQKTKNPIDKDKMQTMYHWIDKSFAPLLVNGELMDMSRGRSISRANSEGHVAAVEVLRGIHRIADMSEGETKQRLQSLVKTIVQSDSYYDVFKNLKTYKDISLMQSLLSDAGVASVPRTSYLSAFNKMDKTAMYNAEKGFGFGLSLFSSRTLNYEHMNKENKRGWYTSDGMFYLYNGDLSHYSDGYWPTVNPYKMPGTTETDAKRADSDTGKVLPSAFVGTSKLDDANATATMDFTNWNQTLTAHKSWFMLKDKIAFLGSNIQNTSTDTAATTIDQRKLESSNPYKVYVNDKEASLTEQEKDYPETQSVFLESSDSKKNIGYFFFKKSSISMSKALQKGAWKDINEGQSDKEVENEFLTISQAHKQNGDSYGYMLIPNVDRATFNQMIKELESSLIENNETLQSVYDAKQGVWGIVKYDDSVSTISNQFQVLKRGVYTIRKEGDEYKIAYYNPETQESAPDQEVFKKLEQAAQPQVQNSKEKEKSEEEKNHSDQKNLPQTGEGQSILASLGFLLLGAFYLFRRGKNN

SEQ ID NO: 84 - protein, 1067 aa, Streptococcus pneumoniae serotype 2 (strain D39/N)
  hyaluronan lyase
MQTKTKKLIVSLSSLVLSGFLLNHYMTVGAEETTTNTIQQSQKEVQYQQRDTKNLVENGDFGQTEDGSSPWTGSKAQGWSAWVDQKNSSADASTRVIEAKDGAITISSPEKLRAAVHRMVPIEAKKKYKLRFKIKTDNKVGIAKVRIIEESGKDKRLWNSATTSGTKDWQTIEADYSPTLDVDKIKLELFYETGTGTVSFKDIELVEVADQPSEDSQTDKQLEEKIDLPIGKKHVFSLADYTYKVENPDVASVKNGILEPLKEGTTNVIVSKDGKEVKKIPLKILASVKDTYTDRLDDWNGIIAGNQYYDSKNEQMAKLNQELEGKVADSLSSISSQADRIYLWEKFSNYKTSANLTATYRKLEEMAKQVTNPSSRYYQDETVVRTVRDSMEWMHKHVYNSEKSIVGNWWDYEIGTPRAINNTLSLMKEYFSDEEIKKYTDVIEKFVPDPEHFRKTTDNPFKALGGNLVDMGRVKVIAGLLRKDDQEISSTIRSIEQVFKLVDQGEGFYQDGSYIDHTNVAYTGAYGNVLIDGLSQLLPVIQKTKNPIDKDKMQTMYHWIDKSFAPLLVNGELMDMSRGRSISRANSEGHVAAVEVLRGIHRIADMSEGETKQRLQSLVKTIVQSDSYYDVFKNLKTYKDISLMQSLLSDAGVASVPRTSYLSAFNKMDKTAMYNAEKGFGFGLSLFSSRTLNYEHMNKENKRGWYTSDGMFYLYNGDLSHYSDGYWPTVNPYKMPGTTETDAKRADSDTGKVLPSAFVGTSKLDDANATATMDFTNWNQTLTAHKSWFMLKDKIAFLGSNIQNTSTDTAATTIDQRKLESSNPYKVYVNDKEASLTEQEKDYPETQSVFLESSDSKKNIGYFFFKKSSISMSKALQKGAWKDINEGQSDKEVENEFLTISQAHKQNGDSYGYMLIPNVDRATFNQMIKELESSLIENNETLQSVYDAKQGVWGIVKYDDSVSTISNQFQVLKRGVYTIRKEGDEYKIAYYNPETQESAPDQEVFKKLEQAAQPQVQNSKEKEKSEEEKNHSDQKNLPQTGEGQSILASLGFLLLGAFYLFRRGKNN

SEQ ID NO: 85 - protein, 805 aa, Streptococcus pyogenes serotype M1
  hyaluronan lyase
MNTYFCTHHKQLLLYSNLFLSFAMMGQGTAIYADTLTSNSEPNNTYFQTQTLTTTDSEKKVVQPQQKDYYTELLDQWNSIIAGNDAYDKTNPDMVTFHNKAEKDAQNIIKSYQGPDHENRTYLWEHAKDYSASANITKTYRNIEKIAKQITNPESCYYQDSKAIAIVKDGMAFMYEHAYNLDRENHQTTGKENKENWWVYEIGTPRAINNTLSLMYPYFTQEEILKYTAPIEKFVPDPTRFRVRAANFSPFEANSGNLIDMGRVKLISGILRKDDLEISDTIKAIEKVFTLVDEGNGFYQDGSLIDHVVTNAQSPLYKKGIAYTGAYGNVLIDGLSQLIPIIQKTKSPIKADKMATIYHWINHSFFPIIVRGEMMDMTRGRSISRFNAQSHVAGIEALRAILRIADMSEEPHRLALKTRIKTLVTQGNAFYNVYDNLKTYHDIKLMKELLSDTSVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTNYQQVGMTGLSDDAFVASKKLNNTSALAAMTFTNWNKSLTLNKGWFILGNKIIFVGSNIKNQSSHKAYTTIEQRKENQKYPYCSYVNNQPVDLNNQLVDFTNTKSIFLESDDPAQNIGYYFFKPTTLSISKALQTGKWQNIKADDKSPEAIKEVSNTFITIMQNHTQDGDRYAYMMLPNMTRQEFETYISKLDIDLLENNDKLAAVYDHDSQQMHVIHYGKKATMFSNHNLSHQGFYSFPHPVRQNQQ

SEQ ID NO: 86 - protein, 780 aa, Streptococcus pyogenes serotype M2 (strain MGAS10)
  hyaluronan lyase
MVYFYLVNQSTFIISFLYWRNVSVNTYFCTHHKQLLLYSNLFLSFAMIGQGTAIYADTLTSNSEPNNTYFQTQTLTTTDSEKKVVQPQQKDYYTELLDQWNSIIAGNDAYDKTNPDMVTFHNKAEKDAQNIIKSYQGPDHENRTYLWEHAKDYSASTNITKTYRNIEKIAKQITNPESCYYQDSKAIAIVKDGMAFMYEHAYNLNRENHQTTGKENKENWWVYEIGTPRAINNTLSLMYPYFTQEEILKYTAPIEKFVPDPTRFRVRAANFSPFEANSGNLIDMGRVKLISGILRKDDLEISDTIKAIEKVFTLVDEGNGFYQDGSLIDHVVTNTQSPLYKKGIAYTGAYGNVLIDGLSQLIPIIQKTKSPIEADKMATIYHWINHSFFPIIVRGEMMDMTRGRSISRFNAQSHVAGIEALRAILRIADMSEEPHRLELKTRIKTLVTQGNAFYNVYDNLKTYHDIKLMKELLSDTSVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTNYQQVGMTSLSDDAFVASKKLNNTSALAAMTFTNWNKSLTLNKGWFILGNKIIFVGSNIKNQSSHKAYTTIEQRKENQKHPYCSYVNNQPVDLNNQLVDFTNTKSIFLESDDPAQNIGYYFFKPRTLSISKALQTGKWQNIKADDKSPEAIKEVSNTFITIMQNHTQEGDRYAYMMLPNMTRQEFETYISKLDIDLLENN

SEQ ID NO: 87 - protein, 868 aa, Streptococcus pyogenes serotype M4 (strain MGAS10)
  hyaluronan lyase
MNTYFCTHHKQLLLYSNLFLSFAMMGQGTAIYADTLTSNSKPNNTYFQTQTLTTTDSEKKVVQPQQKDYYTELLDQWNSIIAGNDAYDKTNPDMVTFHNKAEKDAQNIIKSYQEPDHENRTYLWEHAKDYSASANITKTYRNIEKIAKQITNPESCYYQDSKAIAIVKDGMAFMYEHAYNLDRENHQTTGKENKENWWDYEIGTPRAINNTLSLMYPYFTQEEILKYTAPIEKFVPDPTRFRVRAANFPPFEANSGNLIDMGRVKLISGILRKDDLEISDTIKAIEKVFTLVDEGNGFYQDGSLIDHVVTNAQSPLYKKGIAYTGAYGNVLIDGLSQLIPIIQKTKSPIEADKMATIYHWINHSFFPIIVRGEMMDMTRGRSISRFNAQSHVAGIEALRAILRIADMSEEPHRLALKTRIKTLVTQGNVFYNVYDNLKTYHDIKLMKELLSDTSVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTNYQQVGMTSLSDDAFVASKKLNNTSALAAMTFTNWNKSLTLNKGWFILGNKIIFVGSNIKNQSSHKAYTTIEQRKENQKHPYCSYVNNQPVDLNNQLVDFTNTKSIFLESDDPAQNIGYYFFKPTTLSISKALQTGKWQNIKADDKSPEAIKEVSNTFITIMQNHTQDGDRYAYMMLPNMTRQEFETYISKLDIDLLENNDKLAAVYDHDSQQMHVIHYEKKATTFSNHNLSHQGFYSFPHPVKQNQQQKLAHQGIAAKNNALNSHKIPHKRQRRLPRTGYQSSSLEFLGGALVASFNHITKPFRKKDLRI

SEQ ID NO: 88 - protein, 828 aa, Streptococcus pyogenes serotype M6
  hyaluronan lyase
MVYFYLVDQFTFIISFLYWRNLSVNTYFCTHHKQLLLYSNLFLSFAMMGQGTAIYADTLTSNSEPNNTYFQTQTLTTTDSEKKVVQPQQKDYYTELLDQWNSIIAGNDAYDKTNPDMVTFHNKAEKDAQNIIKSYQGPDHENRTYLWEHAKDYSASTNITKTYRNIEKIAKQITNPESCYYQDSKAIAIVKDGMAFMYEHAYNLDRENHQTTGKENKENWWVYEIGTPRAINNTLSLMYPYFTQEEILKYTAPIEKFVPDPTRFRVRAANFSPFEANSGNLIDMGRVKLISGILRKDDLEISDTIKAIEKVFTLVDEGNGFYQDGSLIDHVVTNAQSPLYKKGIAYTGAYGNVLIDGLSQLIPIIQKTKSPIEADKMATIYHWINHSFFPIIVRGEMMDMTRGRSISRFNAQSHVAGIEALRAILRIADMSEEPHRLALKTRIKTLVTQGNAFYNVYDNLKTYHDIKLMKELLSDTFVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTDYQQVGMTSLSDDAFVASKKLNNTSALAAMTFTNWNKSLTLNKGWFILGNKIIFVGSNIKNQSSHKAYTTIEQRKENQKHPYCSYVNNQPVDLNNQLVDFTNTKSIFLESDDPAQNIGYYFFKPTTLSISKALQTGKWQNIKADDKSPEAIKEVSNTFITIMQNHTQDGDRYAYMMLPNMTRQEFETYISKLDIDLLENNDKLAAVYDHDSQQMHVIHYEKKATMFSNHNLSHQGFYSFPHPVKQNQQ

SEQ ID NO: 89 - protein, 556 aa, Streptococcus pyogenes serotype M12 (strain MGAS2)
  hyaluronan lyase
MVYFYLVNQSTFIISFLYWRNLSVNTYFCTHHKQLLLYSNLFLSFAMMGQGTAIYADTLTSNSEPNNTYFQTQTLTTTDSEKKVVQPQQKDYYTELLDQWNSIIAGNDAYDKTNPDMVTFHNKAEKDAQNIIKSYQGPDHENRTYLGNMQRIIPLLLISRKLTAILKKISKMKSLMEDSTISTNGLTQQLKIYNDMDRVTYHNKGLDFAFGLSMTSKNVARYESINGENLKGWHTGAGMSYLYNSDVKHYRDNFWATADMKRLAGTTTLDNEEPKSTDVKKSSKTFVGGTKFDDQHASIGMDFENQDKTLTAKKSYFILNDKIVFLGTGIKSTDSSKNPVTTIENRKANDYKLYKDDTQTTNSDNQETNSLFLESTNSTQNNIGYHFLNESKITVKKESHTGKWSDINKSQKDIQKTDEYYEVTQKHSNTDSKYAYVLYPGLSKDVFKSKASKVTVVKQEDDFHVVKDNESVWAGINYSDSAKTFEINNTKVEVKAKGMFILTKKDDNTYECSFYNPESTNSVSDIESKISMTGYSIINKNTSTSNESGVRFELTK

SEQ ID NO: 90 - protein, 635 aa, Streptococcus pyogenes serotype M12 (strain MGAS2)
  hyaluronan lyase
MAFMYEHAYNLNRENHQTTGKENKENWWVYEIGTPRAINNTLSLMYPYFTQEEILKYTAPIEKFVPDPTRFRVRAANFSPFEASSGNLIDMGRVKLISGILRKDDLEISDTIKAIEKVFTLVDEGNGFYQDGSLIDHVVTNAQSPLYKKGIAYTGAYGNVLIDGLSQLIPIIQKTKSPIEADKMATIYHWINHSFFPIIVRGEMMDMTRGRSISRFNAQSHVAGIEALRAILRIADMSEEPHRLALKTRIKTLVTQGNAFYNVYDNLKTYHDIKLMKELLSDTSVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTNYQQVGMTSLSDDAFVASKKLNNTSALAAMTFTNWNKSLTLNKGWFILGNKIIFVGSNIKNQSSHKAYTTIEQRKENQKHPYCSYVNNQPVDLNNQLVDFTNTKSIFLESDDPAQNIGYYFFKPTTLSISKALQTGKWQNIKADDKSPEAIKEVSNTFITIMQNHTQDGDRYAYMMLPNMTRQEFETYISKLDIDLLENNDKLAAVYDHDSQQMHVIHYEKKATMFSNHNLSHQGFYSFPHPVKQNQQ

SEQ ID NO: 91 - protein, 828 aa, Streptococcus pyogenes serotype M12 (strain MGAS9)
  hyaluronan lyase
MVYFYLVNQSTFIISFLYWRNLSVNTYFCTHHKQLLLYSNLFLSFAMMGQGTAIYADTLTSNSEPNNTYFQTQTLTTTDSEKKVVQPQQKDYYTELLDQWNSIIAGNDAYVKTNPDMVTFHNKAEKDAQNIIKSYQGPDHENRTYLWEHAKDYSASTNITKTYRNIEKIAKQITNPESCYYQDSKAIAIVKDGMAFMYEHAYNLNRENHQTTGKENKENWWVYEIGTPRAINNTLSLMYPYFTQEEILKYTAPIEKFVPDPTRFRVRAANFSPFEASSGNLIDMGRVKLISGILRKDDLEISDTIKAIEKVFTLVDEGNGFYQDGSLIDHVVTNAQSPLYKKGIAYTGAYGNVLIDGLSQLIPIIQKTKSPIEADKMATIYHWINHSFFPIIVRGEMMDMTRGRSISRFNAQSHVAGIEALRAILRIADMSEEPHRLALKTRIKTLVTQGNAFYNVYDNLKTYHDIKLMKELLSDTSVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTNYQQVGMTSLSDDAFVASKKLNNTSALAAMTFTNWNKSLTLNKGWFILGNKIIFVGSNIKNQSSHKAYTTIEQRKENQKHPYCSYVNNQPVDLNNQLVDFTNTKSIFLESDDPAQNIGYYFFKPTTLSISKALQTGKWQNIKADDKSPEAIKEVSNTFITIMQNHTQDGDRYAYMMLPNMTRQEFETYISKLDIDLLENNDKLAAVYDHDSQQMHVIHYEKKATMFSNHNLSHQGFYSFPHPVKQNQQ

SEQ ID NO: 92 - protein, 828 aa, Streptococcus pyogenes serotype M28
  hyaluronan lyase
MVYFYLVNQFTFIISFLYRRNLSVNTYFCTHHKQLLLYSNLFLSFAMMGQGTAIYADTLTSNSEPNNTYFQTQMLTTTDSEKKVVQPQQKDYYTELLDQWNSIIAGNDAYDKTNPDMVTFHNKAEKDAQNIIKSYQGPDHENRTYLWEHAKDYSASANITKTYRNIEKIAKQITNPESCYYQDSKAIAIVKDGMAFMYEHAYNLDRENHQTTGKENKENWWVYEIGTPRAINNTLSLMYPYFTQEEILKYTAPIEKFVPDPTRFRVRAANFSPFEANSGNLIDMGRVKLISGILRKDDLEISDTIKAIEKVFTLVDEGNGFYQDGSLIDHVVTNAQSPLYKKGIAYTGAYGNVLIDGLSQLIPIIQKTKSSIEADKMATIYHWINHSFFPIIVRGEMMDMTRGRSISRFNAQSHVAGIEALRAILRIADMSEEPHRLALKTRIKTLVTQGNAFYNVYDNLKTYHDIKLMKELLSDTSVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTNYQQVGMTSLSDDAFVASKKLNNTSALAAMTFTNWNKSLTLNKGWFILGNKIIFVGSNIKNQSSHKAYTTIEQRKENQKHPYHAYVNNQPVDLNNQLVDFTNTKSIFLESDDSAQNIGYYFFKPTTLSISKALQTGKWQNIKADDKSPEAIKEVSNTFITIMQNHTQDGDRYAYMMLPNMTRQEFETYISKLDIDLLENNDKLAAVYDHDSQQMHVIHYEKKATMFSNHNLSHQGFYSFPHPVKQNQQ

SEQ ID NO: 93 - protein, 522 aa, Streptococcus suis
  hyaluronan lyase
MGFFISQSKQHYGIRKYKVGVCSALIALSILGTRVAANQLPSTETASPQSSQLVETTPETTEAVNLTTEAVMTSEVSSEVSPVTSTETQPSSTAAETLASPQAVQATKEEEKNLVANGEFASTTAASGNWADPAATNWETWIPANVKKENGQVRIDEGRLHISSTASYRVAVHQTVDVDPNKRYLFSYNVETKDLKGSGVRVRLRSLTAEGKDLSPQEFAYTPYKNGSQAEHIEQILTVSPETRKLKVELFFENSVGQAWLDNISLVEYVEKTPETPEPSLELVQPETGQISLASNKVYLPVRPDLTYRIADAAVAIVEKNMIRPLAAGKTQVDVYDKDTKLSSFELTVTEHQATVFDTLRNNWEDISLANKRYQSNDTQMKAFLGRLDAGVASSLKKWVEPTNQGKTIFNDIDFSKSSHLTTVYRRLEQMAQVVENPDSAYYHDRSLIDLVRKGMNWLYTNVYNENKSIDGNWWDYEIGTPRAVVNTLIYMHPYFSQEEILTYTKPISKFVPDPTTISVKH

SEQ ID NO: 94 - protein, 1164 aa, Streptococcus suis
  hyaluronan lyase
MGFFISQSKQHYGIRKYKVGVCSALIALSILGTRVAANQLPSTETASPQSSQLVETTPETTEAVMTSEVSSEVSPVTSTETQPSSTTAETLASPQAVQATKEEKNLVANGEFISTTAPSGNWKELAATNWETWIPANVKKENGQVRIDEGRLHISSTASYRVAVHQTVDVDPNKRYLFSYDVETKDLKGSGVRVRLRSLTAEGKDLSPQEFAYTPYKNGSQAEHIEQILTVSPETRKLKVELFFENSVGQAWLDNISLVEYVEKTPETPEQSPELVQPETGQISLASNKVYLPVRPDLTYRIADAAVATVEKNMIRPLAAGKTQVDVYDKDTKLSSFELIVTEHQATVFDTLRNNWEDISLANKRYQSNDAQMKAFLGRLDAGVASSLEKWVEPTEQSKTIFNDIDFSKSSHLTTVYRRLEQMAQVVENPDSAYYHDRSLIDLVRKGMNWLYANVYNENKSIDGNWWDYEIGTSRAVVNTLIYMHPYFSQEEILTYTKPISKFVPDPTTIRKTLTNPVPAVGGNQTDLSKVAILEGALREDADRVRAGAQGLTTIMKFVDKGEGFYRDGSFIDHTNVAYTGAYGNVLIEGFSQLLPVIQPTEFALKEEQTNILYEWIEKAFMPILVRGELMDMTRGRSISRATGESHVQAMEILRSLVRIAESAQPEQKTKLLSFVKAQLTSDTFYDSYRSLKSYKDIDLVNKLLADNQIPAEVDKDYIAAFNNMDKFVYRSAQEGFTFALSMYSSRTQNYEDMNNENRKGWYTADGMVYLYNDDLSHYSNHYWATVDPYRLPGTTTTKDKREDGSGEVTLASDFVGASQLGNRLATIAMDFNNWNNSLTARKAWIVLGNKIVFLGTDIQHQSAQGAETTIENRKLLTGEKYSYYINGQPVDLSKEVVTDKTQSFYMTNGKDNQSIGYVFLNQLPTHAKLDQRTGKWSDINYNQSKEEVSNSFVSLWHEHAQTSSNYAYVLVPNQSMEKVNQAAASVKLLHQDRDLQVVYDQEQNVWGVVKYTDTAYKLTDDITLTDAGLYTIQKVEGGYRIAFYNPSTRTVKNGIELTKAGSSLTVEMEPTAAYPSTVWKVTMPEGSDKQTGSVEKTEKEEKQLKENQPSSEVKQVVHHAAEKTKPSKPRLPQTGEEASLGLGFLGLLTLGAVVDFKCRRSHS

SEQ ID NO: 95 - protein, 1164 aa, Streptococcus suis
  hyaluronan lyase
MGFFISQSKQHYGIRKYKVGVCSALIALSILGTRVAANQLPSTETASPQSSQLVETTPETTEAVMTSEVSSEVSPVTSTETQPSSTTAETLASPQAVQATKEEKNLVANGEFISTTAPSGNWKELAATNWETWIPANVKKENGQVRIDEGRLHISSTASYRVAVHQTVDVDPNKRYLFSYDVETKDLKGSGVRVRLRSLTAEGKDLSPQEFAYTPYKNGSQAEHIEQILTVSPETRKLKVELFFENSVGQAWLDNISLVEYVEKTPETPEQSPELVQPETGQISLASNKVYLPVRPDLTYRIADAAVATVEKNMIRPLAAGKTQVDVYDKDTKLSSFELIVTEHQATVFDTLRNNWEDISLANKRYQSNDAQMKAFLGRLDAGVASSLEKWVEPTEQSKTIFNDIDFSKSSHLTTVYRRLEQMAQVVENPDSAYYHDRSLIDLVRKGMNWLYTNVYNENKSIDGNWWDYEIGTPRAVVNTLIYMHPYFSQEEILTYTKPISKFVPDPTTIRKTLTNPVPAVGGNQTDLSKVAILEGALREDADRVRAGAQGLTTIMKFVDKGEGFYRDGSFIDHTNVAYTGAYGNVLIEGFSQLLPVIQPTEFALKEEQTNILYEWIEKAFMPILVRGELMDMTRGRSISRATGESHVQAMEILRSLVRIAESAQPEQKTKLLSFVKAQLTSDTFYDSYRSLKSYKDIDLVNKLLADNQIPAEVDKDYIAAFNNMDKFVYRSAQEGFTFALSMYSSRTQNYEDMNNENRKGWYTADGMVYLYNDDLSHYSNHYWATVDPYRLPGTTTTKDKREDGSGEVTLASDFVGASQLGNRLATIAMDFNNWNNSLTARKAWIVLGNKIVFLGTDIQHQSAQGAETTIENRKLLTGEKYSYYINGQPVDLSKEVVTDKTQSFYMTNGKDNQSIGYVFLNQLPTHAKLDQRTGKWSDINYNQSKEEVSNSFVSLWHEHAQTSSNYAYVLVPNQSMEKVNQAAASVKLLHQDRDLQVVYDQEQNVWGVVKYTDTAYKLTDDITLTDAGLYTIQKVEGGYRIAFYNPSTRTVKNGIELTKAGSSLTVEMEPTAAYPSTVWKVTMPEGSDKQTGSVEKTEKEEKQLKENQPSSEVKQVVHHAAEKTKPSKPRLPQTGEEASLGLGFLGLLTLGAVVDFKCRRSHS

SEQ ID NO: 96 - protein, 802 aa, Vibrio fischeri (strain ATCC 700601 / ES114)
  hyaluronan lyase
MYMIKKHRLNTIALSMLFLFTGNAYAAKNTQTPQYLPSDFEQVRENWAENYLGDPAITFDQTLKNMVTSTNSSAQKHWDSMTPQPNASGIWDDLPLIDKDTTLGPNIRNSYQRLFTMAKAYRLRDGNLENNQLMLNDIMTAMNYINQNFYFVNQLEYGNWWQWELAIPKDIHNILVLLFDDIKDNYQTIITNHLNATRYFTPDPTHLGVSPGAAESTNPNYRESTGGNRTDNAQVVLIRGMLENNSEEISQAIAALPAVIEYVSEGDGYYTDGSFLQHSDIAYNGTYGNVLLGGLGIQMNAVAGSPWSMDNQTISNVYNIINQSYEPLLYKGAMMDMVNGRSISRSAEQNHDVGLNIVNSMLFYTNGPDSDKNKQLSSLIKTQITDDTYQNFFDKIYYVSTYQAAQHIVNDPTVSLKDPLIGNFSYPSMDRIVHRRTDWAFALAMHSYRIGNYECMNGENLKGWFTGDGMIYLYNDQLDHYTGYWPTVNASRMPGTTVDSQIMADCSGERVGGNVNTNMQWVGSTSLNNYGIAGMQFYNWSDTLSAYKSWFMFDNEVVMLGSNIKDQSNANNITTIENRKRLAETKLFIDGTEQAALPYQGAPATFSIRNKTLANSDLSYVMLTPKTISISQNDVDGNWSDIGNSKGDVSDSYLQATLTQVDQADYQYALLPNQNNDTVQNYAQHPDVTVLRQDEQAHAVQENTLNIIAANNWKNNPVNITDTITLNSMMGFMIKEESSNTFTVAVSEPIQTIDSVNFTFDKQGIVIKEDIENRVVLNGTTLTINTSGLQGQSYSFQVTIQD

SEQ ID NO: 97 - protein, 517 aa, Synechococcus sp. (strain RCC307)
  hyaluronan lyase
MGAPAIPKVPRSPSKSEHTTRPNSGESEVVRQAEELFEQTLVNVRGQLAGAVAALESSVHDSELNYGEIFLRDNVPVMVYLLLRGRFEIVRHFLDLCLELQSRSYRTRGVFPTSFVEEDDKILADYGQRSIGRITSVDASLWWPVLCWMYVRASGDTSYGTSPKVQRAVQLLLDLVLQPSFYEPPVLFVPDCAFMIDRPMDVWGAPLEVEVLLFGCLKSCCQLMSLVEGGGHGGPLIQQRLELTRTWMRDLRVYLLNHYWVTSKTMQVLRRRPTEQYGDYQSRNEFNVQPEVIPHWLQEWLDDRGGYLIGNMRTGRPDFRFYSLGNALGSLFGLLTGPQQLALFRLVIHNRQHLMAEMPMRICHPPMDQDEWITNTGMDPKNWPWSYHNGGHWPSLLWPMAAAVLMHQRLYPNDDLLLLGQTRTMLEECYWQQLNQLPRQQWAEYFDGPTGTWVGQQARINQTWTIVGFLLLHHLMRKAPQDVKLLDLDDVGPLRLSFQDQHEKSSTDERKSFLKNY

SEQ ID NO: 98 - protein, 1021 aa, Proteus vulgaris
  chondroitin-sulfate-ABC endolyase
MPIFRFTALAMTLGLLSAPYNAMAATSNPAFDPKNLMQSEIYHFAQNNPLADFSSDKNSILTLSDKRSIMGNQSLLWKWKGGSSFTLHKKLIVPTDKEASKAWGRSSTPVFSFWLYNEKPIDGYLTIDFGEKLISTSEAQAGFKVKLDFTGWRAVGVSLNNDLENREMTLNATNTSSDGTQDSIGRSLGAKVDSIRFKAPSNVSQGEIYIDRIMFSVDDARYQWSDYQVKTRLSEPEIQFHNVKPQLPVTPENLAAIDLIRQRLINEFVGGEKETNLALEENISKLKSDFDALNIHTLANGGTQGRHLITDKQIIIYQPENLNSQDKQLFDNYVILGNYTTLMFNISRAYVLEKDPTQKAQLKQMYLLMTKHLLDQGFVKGSALVTTHHWGYSSRWWYISTLLMSDALKEANLQTQVYDSLLWYSREFKSSFDMKVSADSSDLDYFNTLSRQHLALLLLEPDDQKRINLVNTFSHYITGALTQVPPGGKDGLRPDGTAWRHEGNYPGYSFPAFKNASQLIYLLRDTPFSVGESGWNNLKKAMVSAWIYSNPEVGLPLAGRHPFNSPSLKSVAQGYYWLAMSAKSSPDKTLASIYLAISDKTQNESTAIFGETITPASLPQGFYAFNGGAFGIHRWQDKMVTLKAYNTNVWSSEIYNKDNRYGRYQSHGVAQIVSNGSQLSQGYQQEGWDWNRMEGATTIHLPLKDLDSPKPHTLMQRGERGFSGTSSLEGQYGMMAFNLIYPANLERFDPNFTAKKSVLAADNHLIFIGSNINSSDKNKNVETTLFQHAITPTLNTLWINGQKIENMPYQTTLQQGDWLIDSNGNGYLITQAEKVNVSRQHQVSAENKNRQPTEGNFSSAWIDHSTRPKDASYEYMVFLDATPEKMGEMAQKFRENNGLYQVLRKDKDVHIILDKLSNVTGYAFYQPASIEDKWIKKVNKPAIVMTHRQKDTLIVSAVTPDLNMTRQKAATPVTINVTINGKWQSADKNSEVKYQVSGDNTELTFTSYFGIPQEIKLSPLP

SEQ ID NO: 99 - protein, 684 aa, Pedobacter heparinus
  chondroitin AC lyase
PALLIAQQTGTAELIMKRVMLDLKKPLRNMDKVAEKNLNTLQPDGSWKDVPYKDDAMTNWLPNNHLLQLETIIQAYIEKDSHYYGDDKVFDQISKAFKYWYDSDPKSRNWWHNEIATPQALGEMLILMRYGKKPLDEALVHKLTERMKRGEPEKKTGANKTDIALHYFYRALLTSDEALLSFAVKELFYPVQFVHYEEGLQYDYSYLQHGPQLQISSYGAVFITGVLKLANYVRDTPYALSTEKLAIFSKYYRDSYLKAIRGSYMDFNVEGRGVSRPDILNKKAEKKRLLVAKMIDLKHTEEWADAIARTDSTVAAGYKIEPYHHQFWNGDYVQHLRPAYSFNVRMVSKRTRRSESGNKENLLGRYLSDGATNIQLRGPEYYNIMPVWEWDKIPGITSRDYLTDRPLTKLWGEQGSNDFAGGVSDGVYGASAYALDYDSLQAKKAWFFFDKEIVCLGAGINSNAPENITTTLNQSWLNGPVISTAGKTGRGKITTFKAQGQFWLLHDAIGYYFPEGANLSLSTQSQKGNWFHINNSHSKDEVSGDVFKLWINHGARPENAQYAYIVLPGINKPEEIKKYNGTAPKVLANTNQLQAVYHQQLDMVQAIFYTAGKLSVAGIEIETDKPCAVLIKHINGKQVIWAADPLQKEKTAVLSIRDLKTGKTNRVKIDFPQQEFAGATVELK

SEQ ID NO: 100 - protein, 844 aa, Victivallis vadensis ATCC BAA-548
  chondroitin AC lyase
MHRKIVFPLFVLLFTAFAAFAASQPQWKWRQSKYCRITEHAGKKLLTVAIPADAPEISRRNTADTPVGLTCFEGQPIEFSIRLRNSGISRPDNLHNGIKFQLYFRDGNGTERWTQAEIPHEPFPWRRFRFSERIPADATSGTLRLGLQGSSGNVEFDLDSLQIRPLDPELSPVPPTPEQIRECELIESRLRAGLPAQQPPPGPEVKKLLERQNGDGTFRDLDYSARNRSIWPAARHLKRTFELALARATPGHALYRDPAAGEAVRKAVAWWAERQPQNGNWWWNDMYVPKILGNILLLSPELFPDGPRRRAALNVCRQACFLSRYTGNNRVFIAANIFCRALLERNLPVMDRAAAVLSEEIRFAPAEHKTAWSFGGIRADGCYHQHGPQIQFGNYGGEFLANIAYWSNILKETHWELSPEQWRIMRHLTFNGFQWVLWRGRMDLLACGRQLGRNAAETKGERTLNAFAQLRNADPGDRAPYDAALRRNRDGENTLTGNRHFWNSDYMVHRRPTWYASVRMNSVRVRPIEDDTNWDNALGRYFSDGACLVMRSGREYENITACWDWTRLPGTTLPKTPVYTGEDARRFGLKIGGGDLPRWTHSRNWRQLGETGFVGGVTDGERGAAVYTQDLDGVRARKAWFFDRDAIYCLGSGITSTSPYEVATTVNSCLRNGEIQQGDGWFRHDGIGYRGENLKLTAGPRTGDWRYVEGGLTRPVPETKELFTLTVEHGVKPRNASYIYTILPGATPEETAGTPPGRVLRNTPECQAVEFADGVRAAIFYEPGRLDDFETDTPGVFLIGKGTVHAADPTGRHSSFTLKLNGVSRKVPLPAGEFAGQSVKIVLK

SEQ ID NO: 101 - protein, 510 aa, Pan troglodytes
  Chimpanzee PH20
MGVLKFKHIFFRSFVKSSGVSQIVFTFLLIPCCLTLNFRAPPVIPNVPFLWAWNAPSEFCLGKFDEPLDMSLFSFIGSPRINVTGQDVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVQEAIRVSKIPDAKSPLPVFVYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEESQIFYNASPSTLSATMFIDLCDLYLVPTSYLIL

SEQ ID NO: 102 - protein, 512 aa, Macaca mulatta
  Rhesus Monkey PH20
MGVLKFKHIFFRSFVKSSGVSQIVFTFLLIPCCLTLNFRAPPIIPNVPFLWAWNAPSEFCLGKFNEPLDMSLFTLMGSPRINITGQGVTIFYVDRLGYYPYIDLTTGVTVHGGIPQKVSLQDHLDKSKQDILFYMPVDNLGMAVIDWEEWRPTWARNWKPKDVYKNRSIELVQQQNVQLSLPQATDKAKQEFEKAGKDFMLETIKLGRSLRPNHLWGYYLFPDCYNHHYRKPGYNGSCFDVEIKRNDDLSWLWNESTALYPSIYLNTQQSVVVATLYVRNRVREAIRVSKIPDAKNPLPVFVYARLVFTDQVLKFLSREELVSTLGETVALGASGIVIWGSLSITRSMKSCLLLDTYMETILNPYIINVTLAAKMCSQVLCQEQGVCIRKDWNSSDYLHLNPDNFDIRLEKGGKFTVHGKPTVEDLEEFSEKFYCSCYTNLSCKEKADVKDTDAVDVCIADGVCIDASLKPPVETEGSPPIFYNTSSSTVSTTMFIWRLEVWDQGISRIGFF

SEQ ID NO: 103 - protein, 505 aa, Homo sapiens
  HuPH20 precursor 1-505
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISS

SEQ ID NO: 104 - protein, 503 aa, Homo sapiens
  HuPH20 precursor 1-503
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLII

SEQ ID NO: 105 - protein, 501 aa, Homo sapiens
  HuPH20 precursor 1-501
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFL

SEQ ID NO: 106 - protein, 499 aa, Homo sapiens
  HuPH20 precursor 1-499
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSIL

SEQ ID NO: 107 - protein, 497 aa, Homo sapiens
  HuPH20 precursor 1-497
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVS

SEQ ID NO: 108 - protein, 495 aa, Homo sapiens
  HuPH20 precursor 1-495
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFI

SEQ ID NO: 109 - protein, 493 aa, Homo sapiens
  HuPH20 precursor 1-493
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATM

SEQ ID NO: 110 - protein, 491 aa, Homo sapiens
  HuPH20 precursor 1-489
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSA

SEQ ID NO: 111 - protein, 489 aa, Homo sapiens
  HuPH20 precursor 1-489
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTL

SEQ ID NO: 112 - protein, 490 aa, Homo sapiens
  HuPH20 precursor 1-490
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLS

SEQ ID NO: 113 - protein, 487 aa, Homo sapiens
  HuPH20 precursor 1-487
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPS

SEQ ID NO: 114 - protein, 485 aa, Homo sapiens
  HuPH20 precursor 1-485
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNAS

SEQ ID NO: 115 - protein, 484 aa, Homo sapiens
  HuPH20 precursor 1-484
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNA

SEQ ID NO: 116 - protein, 476 aa, Homo sapiens
  HuPH20 precursor 1-476
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETE

SEQ ID NO: 117 - protein, 475 aa, Homo sapiens
  HuPH20 precursor 1-475
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMET

SEQ ID NO: 118 - protein, 474 aa, Homo sapiens
  HuPH20 precursor 1-474
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPME

SEQ ID NO: 119 - protein, 473 aa, Homo sapiens
  HuPH20 precursor 1-473
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPM

SEQ ID NO: 120 - protein, 472 aa, Homo sapiens
  HuPH20 precursor 1-472
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPP

SEQ ID NO: 121 - protein, 471 aa, Homo sapiens
  HuPH20 precursor 1-471
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKP

SEQ ID NO: 122 - protein, 470 aa, Homo sapiens
  HuPH20 precursor 1-470
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLK

SEQ ID NO: 123 - protein, 469 aa, Homo sapiens
  HuPH20 precursor 1-469
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFL

SEQ ID NO: 124 - protein, 468 aa, Homo sapiens
  HuPH20 precursor 1-468
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 125 - protein, 466 aa, Homo sapiens
  HuPH20 precursor 1-466
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCID

SEQ ID NO: 126 - protein, 465 aa, Homo sapiens
  HuPH20 precursor 1-465
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCI

SEQ ID NO: 127 - protein, 464 aa, Homo sapiens
  HuPH20 precursor 1-464
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVC

SEQ ID NO: 128 - protein, 462 aa, Homo sapiens
  HuPH20 precursor 1-462
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADG

SEQ ID NO: 129 - protein, 460 aa, Homo sapiens
  HuPH20 precursor 1-460
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIA

SEQ ID NO: 130 - protein, 458 aa, Homo sapiens
  HuPH20 precursor 1-458
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVC

SEQ ID NO: 131 - protein, 456 aa, Homo sapiens
  HuPH20 precursor 1-456
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVD

SEQ ID NO: 132 - protein, 454 aa, Homo sapiens
  HuPH20 precursor 1-454
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDA

SEQ ID NO: 133 - protein, 452 aa, Homo sapiens
  HuPH20 precursor 1-452
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDT

SEQ ID NO: 134 - protein, 450 aa, Homo sapiens
  HuPH20 precursor 1-450
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVK

SEQ ID NO: 135 - protein, 508 aa, Homo sapiens
  HuPH20 precursor 1-508
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVAS

SEQ ID NO: 136 - protein, 506 aa, Homo sapiens
  HuPH20 precursor 1-506
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSV

SEQ ID NO: 137 - protein, 504 aa, Homo sapiens
  HuPH20 precursor 1-504
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIIS

SEQ ID NO: 138 - protein, 502 aa, Homo sapiens
  HuPH20 precursor 1-502
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLI

SEQ ID NO: 139 - protein, 500 aa, Homo sapiens
  HuPH20 precursor 1-500
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILF

SEQ ID NO: 140 - protein, 498 aa, Homo sapiens
  HuPH20 precursor 1-498
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSI

SEQ ID NO: 141 - protein, 496 aa, Homo sapiens
  HuPH20 precursor 1-496
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIV

SEQ ID NO: 142 - protein, 494 aa, Homo sapiens
  HuPH20 precursor 1-494
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMF

SEQ ID NO: 143 - protein, 492 aa, Homo sapiens
  HuPH20 precursor 1-492
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSAT

SEQ ID NO: 144 - protein, 488 aa, Homo sapiens
  HuPH20 precursor 1-488
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPST

SEQ ID NO: 145 - protein, 486 aa, Homo sapiens
  HuPH20 precursor 1-486
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASP

SEQ ID NO: 146 - protein, 472 aa, Homo sapiens
  mature HuPH20 36-507
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVA

SEQ ID NO: 147 - protein, 470 aa, Homo sapiens
  mature HuPH20 36-505
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISS

SEQ ID NO: 148 - protein, 468 aa, Homo sapiens
  mature HuPH20 36-503
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLII

SEQ ID NO: 149 - protein, 466 aa, Homo sapiens
  mature HuPH20 36-501
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFL

SEQ ID NO: 150 - protein, 464 aa, Homo sapiens
  mature HuPH20 36-499
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSIL

SEQ ID NO: 151 - protein, 462 aa, Homo sapiens
  esHuPH20 36-497
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVS

SEQ ID NO: 152 - protein, 460 aa, Homo sapiens
  esHuPH20 36-495
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFI

SEQ ID NO: 153 - protein, 458 aa, Homo sapiens
  esHuPH20 36-493
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATM

SEQ ID NO: 154 - protein, 456 aa, Homo sapiens
  esHuPH20 36-491
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSA

SEQ ID NO: 155 - protein, 454 aa, Homo sapiens
  mature HuPH20 36-489
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTL

SEQ ID NO: 156 - protein, 455 aa, Homo sapiens
  mature HuPH20 36-490
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLS

SEQ ID NO: 157 - protein, 452 aa, Homo sapiens
  mature HuPH20 36-487
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPS

SEQ ID NO: 158 - protein, 450 aa, Homo sapiens
  Mature HuPH20 36-485
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNAS

SEQ ID NO: 159 - protein, 449 aa, Homo sapiens
  Mature HuPH20 36-484
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNA

SEQ ID NO: 160 - protein, 441 aa, Homo sapiens
  Mature HuPH20 36-476
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETE

SEQ ID NO: 161 - protein, 440 aa, Homo sapiens
  Mature HuPH20 36-475
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMET

SEQ ID NO: 162 - protein, 439 aa, Homo sapiens
  Mature HuPH20 36-474
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPME

SEQ ID NO: 163 - protein, 438 aa, Homo sapiens
  Mature HuPH20 36-473
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPM

SEQ ID NO: 164 - protein, 437 aa, Homo sapiens
  Mature HuPH20 36-472
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPP

SEQ ID NO: 165 - protein, 436 aa, Homo sapiens
  Mature HuPH20 36-471
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKP

SEQ ID NO: 166 - protein, 435 aa, Homo sapiens
  Mature HuPH20 36-470
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLK

SEQ ID NO: 167 - protein, 434 aa, Homo sapiens
  Mature HuPH20 36-469
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFL

SEQ ID NO: 168 - protein, 433 aa, Homo sapiens
  Mature HuPH20 36-468
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 169 - protein, 431 aa, Homo sapiens
  Mature HuPH20 36-466
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCID

SEQ ID NO: 170 - protein, 430 aa, Homo sapiens
  Mature HuPH20 36-465
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCI

SEQ ID NO: 171 - protein, 429 aa, Homo sapiens
  Mature HuPH20 36-464
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVC

SEQ ID NO: 172 - protein, 427 aa, Homo sapiens
  Mature HuPH20 36-462
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADG

SEQ ID NO: 173 - protein, 425 aa, Homo sapiens
  Mature HuPH20 36-460
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIA

SEQ ID NO: 174 - protein, 423 aa, Homo sapiens
  Mature HuPH20 36-458
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVC

SEQ ID NO: 175 - protein, 421 aa, Homo sapiens
  Mature HuPH20 36-456
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVD

SEQ ID NO: 176 - protein, 419 aa, Homo sapiens
  Mature HuPH20 36-454
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDA

SEQ ID NO: 177 - protein, 417 aa, Homo sapiens
  Mature HuPH20 36-452
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDT

SEQ ID NO: 178 - protein, 415 aa, Homo sapiens
  Mature HuPH20 36-450
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVK

SEQ ID NO: 179 - protein, 473 aa, Homo sapiens
  Mature HuPH20 36-508
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVAS

SEQ ID NO: 180 - protein, 471 aa, Homo sapiens
  Mature HuPH20 36-506
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSV

SEQ ID NO: 181 - protein, 469 aa, Homo sapiens
  Mature HuPH20 36-504
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIIS

SEQ ID NO: 182 - protein, 467 aa, Homo sapiens
  Mature HuPH20 36-502
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLI

SEQ ID NO: 183 - protein, 465 aa, Homo sapiens
  Mature HuPH20 36-500
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILF

SEQ ID NO: 184 - protein, 463 aa, Homo sapiens
  Mature HuPH20 36-498
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSI

SEQ ID NO: 185 - protein, 461 aa, Homo sapiens
  esHuPH20 36-496
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIV

SEQ ID NO: 186 - protein, 459 aa, Homo sapiens
  esHuPH20 36-494
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMF

SEQ ID NO: 187 - protein, 457 aa, Homo sapiens
  esHuPH20 36-492
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSAT

SEQ ID NO: 188 - protein, 453 aa, Homo sapiens
  Mature HuPH20 36-488
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPST

SEQ ID NO: 189 - protein, 451 aa, Homo sapiens
  Mature HuPH20 36-486
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASP

SEQ ID NO: 190 - DNA, 2105 bp, Bos taurus
  PH20 DNA
ggtttatctctgttcttggtgaggagacagacagaattgactgctgtgctcatccgcgagggtaaatgtgctcagctctttatggagtagtggagacgggcagagatgacaagatgaagcaacttgcaaaacattcctaaatacgaaggaagaagaatatttaaatgtaaatcatcattattcatttttatccatcaaagtggcttcattctgtgttcatatcttgcatcaaatattaggtacaccaaagcgtgtaggagaaaaaagtgcctttcacagtcatcgctctttgtgatgagaatgctgaggcgccaccatatctcctttcggagctttgctgggtctagcggaacaccccaggcagtgttcaccttccttctgcttccgtgttgtttggctctggacttcagagcaccccctcttatttcaaacacttctttcctctgggcctggaatgccccagttgaacgttgtgttaacagaagatttcaactacctccagatctgagactcttctctgtaaaaggaagcccccagaaaagtgctaccggacaatttattacattattttatgctgatagacttggctactatcctcatatagatgaaaaaacaggcaaaaccgtattcggaggaattccccagttgggaaacttaaaaagtcatatggagaaagcaaaaaatgacattgcctattacataccaaatgacagcgtgggcttggcggtcattgactgggaaaactggaggcctacctgggcaagaaactggaaacctaaagatgtttacagggatgagtcagttgagttggttctgcaaaaaaatccgcaactcagtttcccagaggcttccaagattgcaaaagtggattttgagacagcaggaaagagtttcatgcaagagactttaaaactgggaaaattacttcggccaaatcacttatggggttattatctttttcctgattgttacaatcataatcataaccaacctacttacaatggaaattgccctgatgtagaaaaaaggagaaatgatgatctcgagtggttgtggaaggaaagcactgcccttttcccttctgtttatttgaatatcaggttaaaatctactcaaaatgctgccttgtatgttcgtaatcgtgtccaggaagccattcggttgtctaaaatagcgagtgtcgaaagtccacttccggtttttgtatatgcccgtccagtttttactgatgggtcttcaacatatctttctcagggtgaccttgtgaattcggttggtgagatcgtttctctaggtgcctctgggattataatgtggggcagtctcaatctaagcttatctatgcaatcttgcatgaacctaggcacttacttgaacactacactgaatccttacataatcaacgtcaccctagccgccaaaatgtgcagccaagtgctttgccacaatgaaggagtgtgtacaaggaaacactggaattcaagcgactatcttcacctgaacccaatgaattttgctattcaaactggggaaggtggaaaatacacagtacctgggacagtcacacttgaagacttgcaaaagttttctgatacattttattgcagttgttatgccaacatccactgtaagaagagagttgatataaaaaatgttcatagtgttaacgtgtgtatggcagaagacatttgtatagacagccctgtgaagttacaacccagtgatcattcctccagccaggaggcatctactaccaccttcagcagtatctcaccctccactacaactgccacagtatctccatgtactcctgagaaacactcccctgagtgcctcaaagtcaggtgttcggaagtcatccccaacgtcacccaaaaggcgtgtcaaagtgttaaattgaagaacatttcctatcagtcacctattcaaaatattaaaaatcaaacaacctattaaaattaaattcagtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaa

SEQ ID NO: 191 - DNA, 1971 bp, Bos taurus
  Hyal1 DNA
ttggtgcgcctggtgccagacttaaggaacagaatcttgctgatgcctgcacaggccctcgccctggggtcaggaagtttggagaatgaggcctttcagccttgaggtttccctacacctgccctgggctatggcagcccacttgcttcctgtctgcaccctgttcctgaacttgctcagcatgacccaaggctcccgggaccctgtggtccccaaccagcccttcactaccatctggaatgccaacaccgagtggtgtatgaagaaacacggcgtggacgtagacatcagtatctttgatgtggtgaccaacccggggcagaccttccgcggccctaacatgaccattttctacagctcccagctgggtacctacccttactatacatctgctggggagcctgtgtttggtggcctgccccagaatgccagcctgaatgcccacctggcccgcacattccaggacatcctggctgccatgcctgagcctcgcttctcagggctggcagtcattgactgggaggcatggcgcccgcgctgggccttcaactgggacaccaaggacatttaccggcagcgctcacgggcattggtacagaagcagcacccagactggctagctcctcgggtggaggccgcagctcaggaccagttcgagggggctgcagaggagtggatggcaggcaccctcaagctgggacaagcactgcgccctcagggcctctggggcttctataatttccctgagtgctacaactatgactttaaaagtcccaactatacaggccggtgtccactaaacatctgtgcccagaatgaccagctcgggtggctgtggggccagagccgtgccctctaccccagcatctacctgcctgcagcactggagggcacgaagaagacacagatgttcgtgcagcaccgtgtggctgaggcattccgtgtggcagcgggtgcgggggaccccaagctgccggtgctgccctacatgcagctcttctacgacatgactaaccactttctgcccgcggaggagctggagcacagcctgggggagagtgcagcccagggtgcagcgggagtggtgctctgggtgagctggctgagcacaagcaccaaggaatcatgccaggccatcaaggagtatgtggacacgacgctgggaccctccatcctgaatgtgaccagcggggctcgtctgtgcagtcaggtcctatgctccggccatggccgttgtgcccggcgccccagttaccccaaggcccgcctcatcctcaactccaccagtttttccatcaagcctacacctggtggtgggcccctgaccctacaaggtgccctctcgctcgaggatcggttgcggatggcagtggagttcgaatgtcgctgctaccgtgggtggagggggacacggtgtgagcagtggggcatgtggtgattggcatgggcacgcactgagtacctgatgcaagctgggcctggctaggtagggctttcccaagtccaggcagtcacaggagtcatggttacagtcagaagtccactcagccagtgtcatgagcatacaccagtgtgcacacctgcttacagaccaagatagctgcataaggacacggtgtgagcagtggggcatatgctgattggcatgggcacacactgagtacctgatgcaatctgggcctggctagggctttcccaagtccaggcagtcacaggagtcatggttaggcatccagtcacaggagtcatgtcaggcatcctgccgacagagtcaaaaatacttcctctggagacactgagtcagtcttcaaacagaagcagtcacaagcactgacattcgggacttccctggccatccagtggttaagacacggagcttccactgcagggggcacgggcagagactaagatcacgaatgctaagcggtgcggttaaacaaataacaaataaataaactgacattcactggg

SEQ ID NO: 192 - DNA, 1912 bp, Bos taurus
  Hyal2 DNA
caagtcgccggcgggctgcccaaagggcaggagctggcgcgaatagcttggctagagacttaccccgggaaggagggaggccgccgacctactgggccgacggactcccacacagttcctgagctggtgcctggcaggtgacactgacttcctgcagcccccagcatgtggacaggcctgggccccgccgtcacactggccctggtgttggtggtggcatgggccacggagctgaagcccacagcaccacccatcttcacgggccggccctttgtggtcgcatgggatgtgcccacacaggactgtggcccgcgccacaagatgccattggacccaaaggacatgaaggcctttgatgttcaggcttcacctaacgagggttttgtaaatcagaacatcaccatcttctaccgtgaccggctgggcatgtatccacacttcaattcggtggggaggtcagtacatggtggtgtgccacagaatggcagcctctgggtacacctggagatgctgaagggacacgtggaacactacattcgtacacaggagcctgcagggctggcagtcatcgactgggaggactggcggccagtgtgggtgcgcaactggcaggacaaggatgtgtaccgccgattatcacgccatttggtagccattcgccaccctgattggccaccagagcgcgtagccaaggaggcgcagtatgagtttgagttcgctgcacggcagttcatgctggagacattgcgatttgtcaaggcgtttcggcctcggcacctatggggcttctacctcttccctgactgttacaaccatgattatgtgcagaactgggagacctatacaggccgctgccctgatgttgaggtctcccgaaatgaccagctggcctggctctgggccgagagcacggccctcttcccctctgtctacttggaagagacactggcttcctccactcacggccgcaactttgtcagctttcgtgtccaggaggctcttcgcgtggctgacgtccaccatgccaaccatgcactccccgtctacgtcttcacgaggcccacctatagccgtggactcacagggcttagcgagatggatctcatctccaccattggtgagagtgctgccctgggtgcagctggcgtcatcctctggggtgacgcagggtttaccaccagcaacgagacctgccgacgcctcaaggattatctgactcggtcattggtaccctatgtcgtcaatgtgtcctgggctgcccagtactgcagctgggcccagtgccatggccatgggcgctgtgtgcgccgggaccccaacgctcacaccttcctgcacctcagtgccagcagcttccgtctagtgcctagccacgcacctgatgagccgcggctgcgaccagagggggaactcagttgggccgaccgcaaccacctacagatgcactttcgctgccagtgctacttaggctggggcggtgagcaatgccagtgggaccgcaggcgggcagctgggggtgccagtggggcctgggctgggtcccacctcactggcctgctggcagtggcagtcctggccttcacctagactttgtaagggtctctcacccagctgccacgccagctggcctctgccacaaggggtctgtcaggcatgtaggagcctgcaaggggtggacaaaccagagtctggaggggcagagccctctgggatgcctggtaggatgtccttaccagctcccaccccctgttctaagggggaggggcagtcccctggaaggccccgtctctccctgccagagaggaagaggggcacagctgggccggggaggacctgaccctactcccctgcccctggatagtttattattattattttggggtctcttttgtaaattaaatataaaacaact

SEQ ID NO: 193 - DNA, 1537 bp, Ovis aries
  Hyal2 DNA
gcaaatgacactgacttcctgcagcccccagcatgtggacaggcctgggccccgccgtcacactggccctggtgttggtggtggcatgggccacagagctgaagcccacagcaccacccatcttcacgggccggccctttgtggttgcatgggatgtgcccacacaggactgtggcccacgccacaagatgccattggacccaaaggacatgaaggcctttgatgtgcaggcctcacctaacgagggttttgtaaatcagaacatcaccatcttctaccgtgaccggctgggcatgtatccacacttcaactcggtggggaggtcagtccatggtggtgtgccacagaatggcagcctctgggtacacctggagatgctgaagggacacgtggaacactacattcgtacacaggagcctgcagggctggcagtcatcgactgggaggactggcggccagtgtgggtgcgcaactggcaggacaaggatgtgtaccgccgattatcacgccagttggtggccagtcaccaccccgattggccaccagagcgcatagtcaaggaggcgcagtatgagtttgagttcgctgcacggcagttcatgctggagacactgcgatttgtcaaggcgtttcggcctcggcacctatggggcttctacctcttccctgactgttacaaccatgattatgtgcaaaactgggagacctatacaggccgctgccctgatgttgaggtctcccgaaatgaccagctgtcctggctctgggccgagagcacagccctcttcccctctgtctacctggaagagacgctggcttcctccactcacggccgcaactttgtcagctttcgtgtccaggaggctcttcgcgtggctgacgtccaccatgccaaccatgcactcccagtctacgtcttcacgaggcccacctacagccgtggactcacagggcttagcgagatggatctcatctccaccattggtgagagtgctgccctgggtgcagccggcgtcatcctctggggtgacgcagggtttaccaccagcaacgagacctgccgacgcctcaaggattatctgactcggtcactggtaccctatgtcgtcaatgtgtcctgggctgcccagtactgcagctgggcccagtgccatggccatgggcgctgtgtgcgccgggaccccaacgctcacaccttcctgcacctcagtgccagcagcttccgtctagtgcctagccacgcacctgatgagccgcggctgcgaccagagggggagctcagttgggccgaccgcaaccacctacagacgcactttcgctgccagtgctacttaggctggggcggtgagcagtgccagtgggaccgcaggcgggcagctgggggtgccagtggggcctgggctgggtcccacctcactggcctgctggcagtggcagtcctggccttcacctggacttcgtaagggtctcacccagctgccaggccagctggcctctgccacaaggggtctgccaggcatgtagcagcccacaaggg

SEQ ID NO: 194 - DNA, 1967 bp, Ovis aries
  Hyaluronidase DNA
actcctgtttatctctgttcttggtgaggagacagacagaattgactgctgtgctcatccaccaggttacagatgaagcaacttgcaaaacattcctaaatacgaaggaagaagagtatttaaacgtaaatcatcattattcatttttatccatcaaagtagcttcattctgtgttcctatcttgcatcaaatattaggtaaaccaaagtgtgtaggagaaaaaagtgcttttcatagtcatcgctctttgtgaagagaatgctaaggcgccgccatatctcctttaggagctttgttggggccagtggaacaccccaggcggcgctcgccttccttctgcttccatgttggttggctctggacttcagagcaccccctcttatttcaaacacttctttcctctgggcctggaatgccccagctgaacgttgtgttaaaatctttaaactacctccagatctgagactcttctctgtaaaaggaagcccccaaaaaagtgctacgggacaatttattacattattttatgctgatagacttggctactatcctcatatagatgaaaaaacaggcaacaccgtatatggaggaattccccagttgggaaacttaaaaaatcatttggaaaaagccaaaaaagacattgcctattatataccaaatgacagcgtgggcttggcggtcattgactgggaaaactggaggcctacctgggcaagaaactggaaacctaaagatgtttacagggatgagtctgttgagttggttctgcaaaaaaatccacaactcagtttcccagaggcttccaagattgcaaaagtggattttgagacagcaggaaagagtttcatgcaagagactttaaaactgggaaaattacttcggccaaatcacttatggggttattatctttttcctgattgttacaatcataattataaccagcctacttacaatggaaattgctctgatttagaaaaaaggagaaatgatgatctcgactggttgtggaaggaaagcactgcccttttcccttctgtttatttgaatatcaagttaaaatctactccaaaagctgccttctatgttcgtaatcgtgtccaggaagccattcggttgtctaaaatagcgagtgttgaaagtccacttccggtttttgtatatcaccgtccagtttttactgatgggtcttcaacatacctttctcagggtgaccttgtgaattcggttggtgagatcgttgctctaggtgcctctgggattataatgtggggcagtctcaatctaagcctaactatgcaatcttgcatgaacctaggcaattacttgaacactacactgaatccttacataatcaacgtcaccctagcagccaaaatgtgcagccaagtgctttgccacgatgaaggagtgtgtacaaggaaacaatggaattcaagcgactatcttcacctgaacccaatgaattttgctattcaaactgggaaaggtggaaaatacacagtacctgggaaagtcacacttgaagacctgcaaacgttttctgataaattttattgcagttgttatgccaacatcaactgtaagaagagagttgatataaaaaatgttcatagtgttaatgtatgtatggcagaagacatttgtatagagggccctgtgaagttacaacccagtgatcattcctctagccagaatgaggcatctactaccaccgtcagcagtatctcaccctctactacagccaccacagtatctccatgtactcctgagaaacagtcccctgagtgcctcaaagtcaggtgtttggaagccatcgccaacgtcacccaaacggggtgtcaaggtgttaaatggaagaacacttccagtcagtcaagtattcaaaatattaaaaatcaaacaacctattaaaatataaattcagtgcttattaagaaaaaaaaaaaaaaaaaaaaaaaaaaaa

SEQ ID NO: 195 - DNA, 2116 bp, Homo sapiens
  HAS1
cggagagaagagagagcccggccagacccactgcgatgagacagcaggacgcgcccaagcccactcctgcagcctgccgctgctccggcctggcccggagggtgctgaccatcgccttcgccctgctcatcctgggcctcatgacctgggcctacgccgccggggtgccgctggcctccgatcgctacggcctcctggccttcggcctctacggggccttcctttcagcgcacctggtggcgcagagcctcttcgcgtacctggagcaccggcgggtggcggcggcggcgcgggggccgctggatgcagccaccgcgcgcagtgtggcgctgaccatctccgcctaccaggaggaccccgcgtacctgcgccagtgcctggcgtccgcccgcgccctgctgtacccgcgcgcgcggctgcgcgtcctcatggtggtggatggcaaccgcgccgaggacctctacatggtcgacatgttccgcgaggtcttcgctgacgaggaccccgccacgtacgtgtgggacggcaactaccaccagccctgggaacccgcggcggcgggcgcggtgggcgccggagcctatcgggaggtggaggcggaggatcctgggcggctggcagtggaggcgctggtgaggactcgcaggtgcgtgtgcgtggcgcagcgctggggcggcaagcgcgaggtcatgtacacagccttcaaggcgctcggagattcggtggactacgtgcaggtctgtgactcggacacaaggttggaccccatggcactgctggagctcgtgcgggtactggacgaggacccccgggtaggggctgttggtggggacgtgcggatccttaaccctctggactcctgggtcagcttcctaagcagcctgcgatactgggtagccttcaatgtggagcgggcttgtcagagctacttccactgtgtatcctgcatcagcggtcctctaggcctatataggaataacctcttgcagcagtttcttgaggcctggtacaaccagaagttcctgggtacccactgtacttttggggatgaccggcacctcaccaaccgcatgctcagcatgggttatgctaccaagtacacctccaggtcccgctgctactcagagacgccctcgtccttcctgcggtggctgagccagcagacacgctggtccaagtcgtacttccgtgagtggctgtacaacgcgctctggtggcaccggcaccatgcgtggatgacctacgaggcggtggtctccggcctgttccccttcttcgtggcggccactgtgctgcgtctgttctacgcgggccgcccttgggcgctgctgtgggtgctgctgtgcgtgcagggcgtggcactggccaaggcggccttcgcggcctggctgcggggctgcctgcgcatggtgcttctgtcgctctacgcgcccctctacatgtgtggcctcctgcctgccaagttcctggcgctagtcaccatgaaccagagtggctggggcacctcgggccggcggaagctggccgctaactacgtccctctgctgcccctggcgctctgggcgctgctgctgcttgggggcctggtccgcagcgtagcacacgaggccagggccgactggagcggcccttcccgcgcagccgaggcctaccacttggccgcgggggccggcgcctacgtgggctactgggtggccatgttgacgctgtactgggtgggcgtgcggaggctttgccggcggcggaccgggggctaccgcgtccaggtgtgagtccagccacgcggatgccgcctcaagggtcttcaggggaggccagaggagagctgctgggccccgagccacgaacttgctgggtggttctctgggcctcagtttccctcctctgcaaaacgagggggtcagcccaagattcttcagtctggactatattgggactgggacttctgggtctccagggagggtatttattggtcagggtgtgggatctgaggagtggagggaaagggtcctgctttctcctcgttcttatttaatctccatttctactgtgtgatcaggatgtaataaagaattttatttattttcaaaaaaaaaaaaaaaaaaaaaaaaaaaaa

SEQ ID NO: 196 - DNA, 3275 bp, Homo sapiens
  HAS2
gaagtcaagacgtctggaaagaattacccagtcctggcttcgagcagcccattgaaccagagacttgaaacagccccagccaaagacttttctcccaattctgcgcttcctgggttctgctgagtcttccacaggctttttttttttttttttttttttttaagacgaaaaagagattttctgttatcgggggcagaaagactgaagcccaaaaaaaaaaaaaaaaaaaaaagaaaagaaaagaaaaaagaaaagttaatttatttttaaagcataatttttttaagaattagactgaagtgcaacggaaacataaagagaatattagtgaaattattttttaaagtggggaagaatcaaacatttaagactcccctatcctttttaaatgttgtttttaaatttcttattttttttggccggtcgtctcaaattcatctgatctcttattacctcaattttggaaactgcccgccaccgaccctccgggaccacacagacaggctgaggacgactttatgaccaagagctgaacaagatgcattgtgagaggtttctatgtatcctgagaataattggaaccacactctttggagtctctctcctccttggaatcacagctgcttatattgttggctaccagtttatccaaacggataattactatttctcttttggactgtatggtgcctttttggcatcacacctcatcatccaaagcctgtttgcctttttggagcaccgaaaaatgaaaaaatccctagaaacccccataaagttgaacaaaacagttgccctttgcatcgctgcctatcaagaagatccagactacttaaggaaatgtttgcaatctgtgaaaaggctaacctaccctgggattaaagttgtcatggtcatagatgggaactcagaagatgacctttacatgatggacatcttcagtgaagtcatgggcagagacaaatcagccacttatatctggaagaacaacttccacgaaaagggtcccggtgagacagatgagtcacataaagaaagctcgcaacacgtaacgcaattggtcttgtccaacaaaagtatctgcatcatgcaaaaatggggtggaaaaagagaagtcatgtacacagccttcagagcactgggacgaagtgtggattatgtacaggtttgtgattcagacactatgcttgacccagcctcatctgtggagatggtaaaagttttagaagaagatcccatggttggaggtgttgggggagatgtccagattttaaacaagtacgattcctggatctcattcctcagcagtgtaagatattggatggcttttaatatagaaagggcctgtcagtcttattttgggtgtgttcagtgcattagtggacctctgggaatgtacagaaactccttgttgcatgagtttgtggaagattggtacaatcaagaatttatgggcaaccaatgtagctttggtgatgacaggcatctcacgaaccgggtgctgagcctgggctatgcaacaaaatacacagctcgatctaagtgccttactgaaacacctatagaatatctcagatggctaaaccagcagacccgttggagcaagtcctacttccgagaatggctgtacaatgcaatgtggtttcacaaacatcacttgtggatgacctacgaagcgattatcactggattctttcctttctttctcattgccacagtaatccagctcttctaccggggtaaaatttggaacattctcctcttcttgttaactgtccagctagtaggtctcataaaatcatcttttgccagctgccttagaggaaatatcgtcatggtcttcatgtctctctactcagtgttatacatgtcgagtttacttcccgccaagatgtttgcaattgcaacaataaacaaagctgggtggggcacatcaggaaggaaaaccattgttgttaatttcataggactcattccagtatcagtttggtttacaatcctcctgggtggtgtgattttcaccatttataaggagtctaaaaggccattttcagaatccaaacagacagttctaattgttggaacgttgctctatgcatgctattgggtcatgcttttgacgctgtatgtagttctcatcaataagtgtggcaggcggaagaagggacaacaatatgacatggtgcttgatgtatgatcttccatgttttgacgtttgcagtcacacacaacaccttagttcctctaggggctgtacagtattgtggcatcagataatgccaccaaaggagacatatcactgctgctgggacttgaacaaagacatttatatgggtttattttcattctgccaaagtaaaacaatacatcaacaagaagaaactcagatttaacctgttatttctatgaaaatgggatgaattctttgtttatgcactttttccttactgtgcatccgcctgaaagtgttttgccctatatacctcactagccatgctttatgtgggttatcatggaagaaaaggattttggaaactcaaggaaaagttctttcaacctatacaacctaacttatggactgttttgatagatgataattttttttttttaggaaggattttctttttaactttaccaaatgaaatgccaaaggaagttttaaaggccgttggctgtgctgtattttgatataattgtactgtgtttttaaattttgtatgccaatcttaaagacaaattttgcatattctctattttacttttctgccaaaataaacctgttcttccttttttaaaataaaataagttcttaaaaaatttatacttaaaaaatcctgcccaaaatgtgaagcttggttgactgatgttcatgatagaaagaataaaatgtttctctctctctaccttttaaaattgaatagtttatttctgtgaaagaagtatttaaactttcaatattttaactttttgtttttatttcttttagaaaaggccaatatacctatcacactttggaagtaaaaatacacactttcgtgtgtacctaaaaaaaaaatcgttgaaaatcaaggccaaaggtagtgcaattttttcattaagatttaaaaaaaagggaatgatagtctttgaaagaaaacagtaggcatccagcactggacaaaacatgggtatcaaagatgaataatctttggagattctggcagtgttttcccagaacaagtcaagtggaaagtggagaaattatctgtataattttggacacatacaatgcagtt

SEQ ID NO: 197 - DNA, 4220 bp, Homo sapiens
  HAS3 transcript variant 1
gagtgcgttcgcggctgctttgacctggtgggcgccgcctccggcactgcaccgaggcggggcgccagcgcccaggttgctgggctggccttggcgcccccttcccctacccagagcgcaggcaggcaggggggtcccgccgcgccccttcagcatatgccggtgcagctgacgacagccctgcgtgtggtgggcaccagcctgtttgccctggcagtgctgggtggcatcctggcagcctatgtgacgggctaccagttcatccacacggaaaagcactacctgtccttcggcctgtacggcgccatcctgggcctgcacctgctcattcagagcctttttgccttcctggagcaccggcgcatgcgacgtgccggccaggccctgaagctgccctccccgcggcggggctcggtggcactgtgcattgccgcataccaggaggaccctgactacttgcgcaagtgcctgcgctcggcccagcgcatctccttccctgacctcaaggtggtcatggtggtggatggcaaccgccaggaggacgcctacatgctggacatcttccacgaggtgctgggcggcaccgagcaggccggcttctttgtgtggcgcagcaacttccatgaggcaggcgagggtgagacggaggccagcctgcaggagggcatggaccgtgtgcgggatgtggtgcgggccagcaccttctcgtgcatcatgcagaagtggggaggcaagcgcgaggtcatgtacacggccttcaaggccctcggcgattcggtggactacatccaggtgtgcgactctgacactgtgctggatccagcctgcaccatcgagatgcttcgagtcctggaggaggatccccaagtagggggagtcgggggagatgtccagatcctcaacaagtacgactcatggatttccttcctgagcagcgtgcggtactggatggccttcaacgtggagcgggcctgccagtcctactttggctgtgtgcagtgtattagtgggcccttgggcatgtaccgcaacagcctcctccagcagttcctggaggactggtaccatcagaagttcctaggcagcaagtgcagcttcggggatgaccggcacctcaccaaccgagtcctgagccttggctaccgaactaagtataccgcgcgctccaagtgcctcacagagacccccactaagtacctccggtggctcaaccagcaaacccgctggagcaagtcttacttccgggagtggctctacaactctctgtggttccataagcaccacctctggatgacctacgagtcagtggtcacgggtttcttccccttcttcctcattgccacggttatacagcttttctaccggggccgcatctggaacattctcctcttcctgctgacggtgcagctggtgggcattatcaaggccacctacgcctgcttccttcggggcaatgcagagatgatcttcatgtccctctactccctcctctatatgtccagccttctgccggccaagatctttgccattgctaccatcaacaaatctggctggggcacctctggccgaaaaaccattgtggtgaacttcattggcctcattcctgtgtccatctgggtggcagttctcctgggagggctggcctacacagcttattgccaggacctgttcagtgagacagagctagccttccttgtctctggggctatactgtatggctgctactgggtggccctcctcatgctatatctggccatcatcgcccggcgatgtgggaagaagccggagcagtacagcttggcttttgctgaggtgtgacatggcccccaagcagagcgggtaaagtgcaatgggtaagggagggaaggggaatggaagagaaaagacagggtgggagggaggagggagtgctgtgttttagtctcttaatggtccaaaggacaaatctaaaatgcaaagaacggtgatgtagtatggcctgacagctctgtttagaggaggcaacactgatcccccagatgcagggctgcaggggattctgtgttttcagactgcctgtctgcttgcatctgcacataggcagtagcctcctcctgggctccagagggcactcagaagttgtgctaaaccaagttaagtcccattcagtggcaacttgtgataggtacctgagtgacggcaacctgcggaaggaggttctcccagcccatctgaacacaaccagaggtggcaggagaatttctactgagcgagctgggccggttagtgtatgtcacccccaccccacccctaagtagtcatcaatgcaataagattgcgcctgagatacaaggcccagaagcctgatctttgggcatcagaaaacagggtccaggaatggtgctttatgtgagataccccactccacatcaacattccagggatgagccaaaccagcagggagttagcactgaactgcttttaaaagtgcacattaaaaaggaaagtttgccaggaggaacaaagagattgtggtggtgctaaaggaggccataagctacacagaggccttgggtgttccacctggaaactgctcagacgtctagatgggttcttagcttgtctgtgatctctgctggggagataaaaagattaagccccaacatgttcagaaaagaagtgaagtcttgggtattttaacctgtatactcttgaattcctctcaaattcagctctgatctgaggctaagacacactccccacttcactttcttcaaagccacattttttgaggtatcactgcagtcacctcttctaccctcatcatcataggtaaggttttcaaggtggcaattggggcggagccccggctcttatagaagcttcagcaggaggcaagcgtgttctcagcacatatgggaactatgaggagcctctgatcaaattggctacaatcttggagctgcttggacggattccttggcagccgggttagcatgtgtgactttcaggctactgttcttgacaatcatctccaatggaaagcttttcagtgttcccaaagtgaactctcaaatccaaaatggttatctttgagaccatccattctcctcagtggcttctccagggaattcttacagccaagttgtgacagtcactgcatttgcctgcttctttccagaaaccaaactaggagatgaaactggttcctacatcctaaggttcttgctttctctctcatgcctcctgaggctgtttttggctgttttccctctgctgcttttggggaatgaggggaagccattttccagtgacttgcaatccaggctgttctcagcgttttgagtttaaaacctgggatcctgactaagcctttgacttaagggttgcttgcttgccctccaaatgtcctttctcagaggggccagctaacccgtgcagaaccagcactaaggtggacagcagacaagagggcaagcctctagtgtaccaagtgcttcctacaaagacgcaaggtgtgctctgagccacagatgggcaaaccctggtgctttccttcatctcccacgaactcaagggttttccaggtgtagctaacagttgccacatcacacagacctcgagtttctggtaagactgctggttgacatcagacccaacccatgaaggctggaaggcagcaggcatttgctaaggcagctgatccaggcaatcgttctgctggccaagaagttaaactattttgagcattagaatggaggaaatccggtcagccaagtgcagagttcagacttcgctaagggcttgtttttcttcagcatttacttgaagattaatgtaggatgacaggctctcctggctgtcctaccatcagctctgccttgcactgtggtcgtcaactttcctcaaatcaaaaacaggcaggtacaggtagtgggctcacaacgtttgacctcgactggtttttctaagttattttgtacatttttcagcagcaaaaccaaactgggtcttcagctttatccccgtttcttgcaagggaagagcctttatacaattggacgcattttggtttttcctcattgagaattcaaatcctcttttgtattgtttctacaataatttgtaaacatatttatttttacctgcttttttttttttttttaattttcaggtcaagttttttatactgcacttatttgtcaaaataaagattctcacatatgccggttatctcgaaa

SEQ ID NO: 198 - DNA, 1229 bp, Homo sapiens
  HAS3 transcript variant 2
ggaggggcatggagccgccgcgggcctgctgagctccggagcgcggcagccggcggcacgatgccggtgcagctgacgacagccctgcgtgtggtgggcaccagcctgtttgccctggcagtgctgggtggcatcctggcagcctatgtgacgggctaccagttcatccacacggaaaagcactacctgtccttcggcctgtacggcgccatcctgggcctgcacctgctcattcagagcctttttgccttcctggagcaccggcgcatgcgacgtgccggccaggccctgaagctgccctccccgcggcggggctcggtggcactgtgcattgccgcataccaggaggaccctgactacttgcgcaagtgcctgcgctcggcccagcgcatctccttccctgacctcaaggtggtcatggtggtggatggcaaccgccaggaggacgcctacatgctggacatcttccacgaggtgctgggcggcaccgagcaggccggcttctttgtgtggcgcagcaacttccatgaggcaggcgagggtgagacggaggccagcctgcaggagggcatggaccgtgtgcgggatgtggtgcgggccagcaccttctcgtgcatcatgcagaagtggggaggcaagcgcgaggtcatgtacacggccttcaaggccctcggcgattcggtggactacatccaggtgtgcgactctgacactgtgctggatccagcctgcaccatcgagatgcttcgagtcctggaggaggatccccaagtagggggagtcgggggagatgtccagcccccagggaaaggtatggcagtagaggatgaccaggtccaagctgcccaggtcagagctacggaagcatggtccgttcaccaacgccacgtttctagagagcagtgagctgattctccaatggtgagcaggggactacatgtgaactgggacctgcaggccaatgtatccctgaggaaaagtccacaagaacaattcaagaaactagtaagaaacaatgggcagaaagctgtgggacgaaagcacagcaggcttctgggaggctggagatcctttctctcaagggcaggattattcccacctgccacagttcacatgccacaaataacatctcaccttcagtcaagaaaaacgcaaaggaaaaaaaaaaaaaaaaaaaaaaaaaaaaaaaaaaaaaaaaaaaaaaaaaaaaaaaaaaaaaaaaaaaaaaa

The invention claimed is:

1. A method for ameliorating in a subject an adverse musculoskeletal effect from an administered hyaluronidase, comprising:
   a) systemically administering a hyaluronidase to the subject, wherein:
      the hyaluronidase is a PEGylated soluble human PH20 hyaluronidase;
      the subject is human; and
      the adverse musculoskeletal effect is selected from among:
         an adverse effect that is Grade 3 or Grade 4; and
         an adverse effect that is ongoing or persistent Grade 2 toxicity that fails to resolve over a course of treatment with the hyaluronidase and that limits the ability of the subject to comply with the hyaluronidase therapy;
      the grade of the adverse musculoskeletal effect is defined by Common Terminology Criteria for Adverse Events (CTCAE) scale; and
   b) administering a sufficient amount of a glucocorticoid to the subject to ameliorate the adverse musculoskeletal effect.

2. A method for ameliorating in a subject an adverse musculoskeletal effect from an administered hyaluronidase, comprising:
   a) prior to administering the hyaluronidase, administering a sufficient amount of a glucocorticoid to the subject to ameliorate an adverse musculoskeletal effect of the hyaluronidase when it is administered, wherein:
      the subject is human;
      the adverse musculoskeletal effect is selected from among:
         an adverse effect that is Grade 3 or Grade 4; and
         an adverse effect that is ongoing or persistent Grade 2 toxicity that fails to resolve over a course of treatment with the hyaluronidase and that limits the ability of the subject to comply with the hyaluronidase therapy; and
      the grade of the adverse musculoskeletal effect is defined by Common Terminology Criteria for Adverse Events (CTCAE) scale; and then
   b) systemically administering the hyaluronidase, wherein the hyaluronidase is a PEGylated soluble human PH20 hyaluronidase.

3. The method of claim 1, wherein the glucocorticoid is selected from among a cortisone, dexamethasone, hydrocortisone, methylprednisolone, prednisolone and a prednisone.

4. The method of claim 1, wherein the glucocorticoid is a dexamethasone.

5. The method of claim 1, wherein the glucocorticoid is administered orally.

6. The method of claim 1, wherein the adverse musculoskeletal effect is Grade 3 or Grade 4 and is selected from among one or more of muscle and joint pain and stiffness, stiffness of upper extremities, stiffness of lower extremities, cramping, muscle soreness and tenderness over the entire body, weakness, fatigue and a decrease in range of motion at knee and elbow joints.

7. The method of claim 2, further comprising administering a sufficient amount of a glucocorticoid concurrent with or subsequent to administration of the hyaluronidase.

8. The method of claim 1, wherein the glucocorticoid is co-administered with the hyaluronidase.

9. The method of claim 1, wherein the glucocorticoid is administered prior to administration of the hyaluronidase.

10. The method of claim 1, wherein administration of the glucocorticoid is at least 1 or more hours prior to administration of the hyaluronidase.

11. The method of claim 1, wherein the glucocorticoid is administered subsequent to administration of the hyaluronidase.

12. The method of claim 1, wherein administration of the glucocorticoid is at least 8 hours to 12 hours after administration of the hyaluronidase.

13. The method of claim 1, wherein the glucocorticoid is administered prior to and after administration of the hyaluronidase.

14. The method of claim 1, wherein the amount of glucocorticoid administered is between 0.1 to 20 mgs, inclusive.

15. The method of claim 1, wherein the amount of glucocorticoid administered is between 0.4 to 20 mgs, inclusive.

16. A method of ameliorating in a subject an adverse musculoskeletal effect from an administered hyaluronidase, comprising:
   a) intravenously administering the hyaluronidase, wherein:
      the hyaluronidase is a PEGylated soluble human PH20 hyaluronidase;
      the subject is human; and
      the adverse musculoskeletal effect is selected from among:
         an adverse effect that is Grade 3 or Grade 4; and
         an adverse effect that is ongoing or persistent Grade 2 toxicity that fails to resolve over a course of treatment with the hyaluronidase and that limits the ability of the subject to comply with the hyaluronidase therapy;
      the grade of the adverse musculoskeletal effect is defined by Common Terminology Criteria for Adverse Events (CTCAE) scale; and
   b) administering a sufficient amount of a glucocorticoid to the subject to ameliorate the adverse musculoskeletal effect.

17. The method of claim 1, wherein the hyaluronidase is administered several times a week, twice a week, once a week, every 21 days or once monthly.

18. The method of claim 1, wherein the hyaluronidase is administered to treat a hyaluronan associated disease or condition.

19. The method of claim 18, wherein the hyaluronan associated disease or condition is selected from among one that is associated with high interstitial fluid pressure, a cancer, edema, disc pressure and an inflammatory disease.

20. The method of claim 19, wherein the disease or condition is edema and the edema is caused by organ transplant, stroke or brain trauma.

21. The method of claim 19, wherein the disease or condition is an inflammatory disease and the inflammatory disease is selected from among Rheumatoid arthritis, scleroderma, periodontitis, psoriasis, atherosclerosis, chronic wounds, Crohn's disease, ulcerative colitis and inflammatory bowel disease.

22. A method of ameliorating in a subject an adverse musculoskeletal effect in a subject from an administered hyaluronidase, comprising:
   a) systemically administering a hyaluronidase to the subject in an amount to treat a cancer that is a tumor, wherein:
      the hyaluronidase is a PEGylated soluble human PH20 hyaluronidase;

the subject is human; and the adverse musculoskeletal effect is selected from among:

an adverse effect that is Grade 3 or Grade 4; and an adverse effect that is ongoing or persistent Grade 2 toxicity that fails to resolve over a course of treatment with the hyaluronidase and that limits the ability of the subject to comply with the hyaluronidase therapy;

the grade of the adverse musculoskeletal effect is defined by Common Terminology Criteria for Adverse Events (CTCAE) scale; and b) administering a sufficient amount of a glucocorticoid to the subject to ameliorate the adverse effect.

23. The method of claim 19, wherein the disease or condition is a cancer and the cancer is selected from among any one or more of a late-stage cancer, a metastatic cancer and an undifferentiated cancer.

24. The method of claim 22, wherein the tumor is selected from among ovarian cancer, in situ carcinoma (ISC), squamous cell carcinoma (SCC), prostate cancer, pancreatic cancer, non-small cell lung cancer, breast cancer, brain cancer and colon cancer.

25. The method of claim 22, wherein administration of the hyaluronidase is effected intravenously (IV), subcutaneously, intramuscularly, intradermally, transdermally or sub-epidermally.

26. The method of claim 1, wherein:
the subject has cancer; and
the adverse musculoskeletal effect results from systemic administration of the human hyaluronidase.

27. The method of claim 1, wherein:
the adverse musculoskeletal effect results from intravenous administration of a single dose of a PEGylated hyaluronidase that is 0.00005 mg/kg to 5 mg/kg of the mass of the subject to whom it is administered; and
the amount of hyaluronidase is 0.0005 mg/kg to 5 mg/kg of the mass of the subject to whom it is administered.

28. The method of claim 1, wherein:
the adverse effect results from administration of an amount of PEGylated hyaluronidase in a range between 0.3 Units/kg to 320,000 Units/kg, inclusive, of the mass of the subject; and
the amount of the hyaluronidase administered is in a range between 0.3 Units/kg to 320,000 Units/kg, inclusive, of the mass of the subject.

29. The method of claim 1, wherein:
the adverse effect results from administration of an amount of PEGylated hyaluronidase that is between 0.3 Units/kg and 320,000 Units/kg, inclusive, of the mass of the subject;
the amount of a hyaluronidase administered is between 0.3 Units/kg and 320,000 Units/kg, inclusive, of the mass of the subject; and
the amount of glucocorticoid administered is between 0.4 to 20 mgs, inclusive.

30. The method of claim 1, wherein the human PH20 hyaluronidase is a truncated form thereof lacking a C-terminal glycosylphospatidylinositol (GPI) attachment site or a portion of the GPI attachment site.

31. The method of claim 30, wherein the PH20 or truncated form thereof is administered in a composition comprising a polypeptide having the sequence of amino acids set forth in any of SEQ ID NOS:4-9.

32. The method of claim 1, wherein the glucocorticoid is dexamethasone.

33. The method of claim 22, further comprising administration of a cancer treatment.

34. The method of claim 33, wherein the cancer treatment is selected from among surgery, radiation, a chemotherapeutic agent, a biological agent, a polypeptide, an antibody, a peptide, a small molecule, a gene therapy vector, a virus and DNA.

35. The method of claim 1, wherein:
the hyaluronidase is neutral active and soluble when secreted from a cell; and
the hyaluronidase polypeptide is a C-terminal truncated PH20 selected from:
(a) a polypeptide that consists of the sequence of amino acids 36-467, 36-468, 36-469, 36-470, 36-471, 36-472, 36-473, 36-474, 36-475, 36-476, 36-477, 36-478, 36-479, 36-480, 36-481, 36-482, 36-483, 36-484, 36-485, 36-486, 36-487, 36-488, 36-489, 36-490, 36-491, 36-492, 36-493, 36-494, 36-495, 36-496, 36-497, 36-498, 36-499 or 36-500 of SEQ ID NO:1; or
(b) a polypeptide consisting of a sequence of amino acids that exhibits at least 85% sequence identity to a polypeptide of a).

36. The method of claim 1, wherein:
the hyaluronidase is neutral active and soluble when secreted from a cell; and
the hyaluronidase polypeptide is a C-terminal truncated PH20 selected from:
(a) a polypeptide that consists of the sequence of amino acids set forth in any of SEQ ID NOS: 4-9; or
(b) a polypeptide that consists of a sequence of amino acids that exhibits at least 95% sequence identity to any of SEQ ID NOS: 4-9.

37. The method of claim 36, wherein the PH20 polypeptide consists of a sequence of amino acid residues having at least 98% sequence identity to residues 36-483 of SEQ ID NO:1.

38. The method of claim 1, wherein:
the adverse musculoskeletal effect results from administering the hyaluronidase in an amount that is between 0.1 µg/kg to 1 mg/kg, inclusive, of the mass of the subject to whom it is administered; and
the amount of hyaluronidase administered is between 0.1 mg/kg to 1 mg/kg, inclusive, of the mass of the subject to whom it is administered.

39. The method of claim 1, wherein:
the adverse musculoskeletal effect results from administering the hyaluronidase in an amount that is between 16 to 16,000 Units/kg, inclusive, of the mass of the subject to whom it is administered; and
the amount of hyaluronidase administered is between 16 to 16,000 Units/kg, inclusive, of the mass of the subject to whom it is administered.

40. The method of claim 2, wherein:
the adverse musculoskeletal effect results from administering the hyaluronidase in an amount that is between 0.1 µg/kg to 1 mg/kg, inclusive, of the mass of the subject to whom it is administered; and
the amount of hyaluronidase administered is between 0.1 µg/kg to 1 mg/kg, inclusive, of the mass of the subject to whom it is administered.

41. The method of claim 2, wherein the hyaluronidase polypeptide consists of the sequence of amino acids set forth in any of SEQ ID NOS: 4-9, or consists of a sequence of amino acids that exhibits at least 95% sequence identity to any of SEQ ID NOS: 4-9.

42. The method of claim 16, wherein:
the adverse musculoskeletal effect results from administering the hyaluronidase in an amount that is between 0.1 µg/kg to 1 mg/kg, inclusive, of the mass of the subject to whom it is administered; and
the amount of hyaluronidase administered is between 0.1 µg/kg to 1 mg/kg, inclusive, of the mass of the subject to whom it is administered.

43. The method of claim 16, wherein the hyaluronidase polypeptide consists of the sequence of amino acids set forth in any of SEQ ID NOS: 4-9, or consists of a sequence of amino acids that exhibits at least 95% sequence identity to any of SEQ ID NOS: 4-9.

44. The method of claim 22, wherein:
the adverse musculoskeletal effect results from administering the hyaluronidase in an amount that is between 0.1 µg/kg to 1 mg/kg, inclusive, of the mass of the subject to whom it is administered; and
the amount of hyaluronidase administered is between 0.1 µg/kg to 1 mg/kg, inclusive, of the mass of the subject to whom it is administered.

45. The method of claim 22, wherein the hyaluronidase polypeptide consists of the sequence of amino acids set forth in any of SEQ ID NOS: 4-9, or consists of a sequence of amino acids that exhibits at least 95% sequence identity to any of SEQ ID NOS: 4-9.

46. The method of claim 2, wherein the glucocorticoid is administered orally.

47. The method of claim 16, wherein the glucocorticoid is administered orally.

48. The method of claim 22, wherein the glucocorticoid is administered orally.

49. The method of claim 1, wherein the subject is identified as having an adverse musculoskeletal effect or having had an adverse musculoskeletal effect from a previous administration of the hyaluronidase.

50. The method of claim 1, wherein the adverse musculoskeletal effect is musculoskeletal pain.

51. The method of claim 1, wherein the adverse musculoskeletal effect is difficulty standing or difficulty walking or both.

52. The method of claim 1, wherein the glucocorticoid is administered to the human subject before the hyaluronidase.

53. The method of claim 52, wherein the glucocorticoid is dexamethasone.

54. The method of claim 1, wherein the adverse musculoskeletal effect is Grade 4.

55. The method of claim 1, wherein the adverse musculoskeletal effect is ongoing or persistent Grade 2 toxicity that fails to resolve over a course of treatment with the hyaluronidase and that limits the ability of the subject to comply with the hyaluronidase therapy.

56. The method of claim 1, wherein the adverse musculoskeletal effect is Grade 3.

57. The method of claim 2, wherein the adverse musculoskeletal effect is Grade 4.

58. The method of claim 2, wherein the adverse musculoskeletal effect is ongoing or persistent Grade 2 toxicity that fails to resolve over a course of treatment with the hyaluronidase and that limits the ability of the subject to comply with the hyaluronidase therapy.

59. The method of claim 2, wherein the adverse musculoskeletal effect is Grade 3.

60. The method of claim 16, wherein the adverse musculoskeletal effect is Grade 4.

61. The method of claim 16, wherein the adverse musculoskeletal effect is ongoing or persistent Grade 2 toxicity that fails to resolve over a course of treatment with the hyaluronidase and that limits the ability of the subject to comply with the hyaluronidase therapy.

62. The method of claim 16, wherein the adverse musculoskeletal effect is Grade 3.

63. The method of claim 22, wherein the adverse musculoskeletal effect is Grade 3.

64. The method of claim 22, wherein the adverse musculoskeletal effect is Grade 4.

65. The method of claim 22, wherein the adverse musculoskeletal effect is ongoing or persistent Grade 2 toxicity that fails to resolve over a course of treatment with the hyaluronidase and that limits the ability of the subject to comply with the hyaluronidase therapy.

66. The method of claim 1, wherein the hyaluronidase is administered intravenously.

67. The method of claim 2, wherein the hyaluronidase is administered intravenously.

68. The method of claim 22, wherein the hyaluronidase is administered intravenously.

\* \* \* \* \*

UNITED STATES PATENT AND TRADEMARK OFFICE
CERTIFICATE OF CORRECTION

PATENT NO. : 9,878,046 B2
APPLICATION NO. : 13/135817
DATED : January 30, 2018
INVENTOR(S) : Shepard et al.

Page 1 of 2

It is certified that error appears in the above-identified patent and that said Letters Patent is hereby corrected as shown below:

In the Specification

At Column 8, Line 11, please replace "Eflomithines" with —Eflornithines—;

At Column 8, Line 19 to Line 20, please replace "Fluorocitabines" with —Flurocitabines—;

At Column 8, Line 27, please replace "2 as" with —2as—;

At Column 8, Line 67, please replace "Sizofurans" with —Sizofirans—;

At Column 41, Line 45, please replace "Streptococcus pyogenes (serotype)" with —Streptococcus pyogenes (serotype M1)—;

At Column 55, Line 32, please replace "promoter's" with —promoters—;

At Column 64, Line 6, please replace "reducer" with —reduce—;

At Column 78, Line 57, please replace "Fluorocitabines" with —Flurocitabines—;

At Column 78, Line 64, please replace "2 as" with —2as—;

At Column 79, Line 36, please replace "Sizofurans" with —Sizofirans—;

At Column 80, Line 34, please replace "2 as" with —2as—;

At Column 85, Line 21 to Line 22, please replace "binds with albumin" with —binds with serum albumin—;

At Column 99, Line 14, please replace "Fluorocitabines" with —Flurocitabines—;

Signed and Sealed this
Seventh Day of August, 2018

Andrei Iancu
*Director of the United States Patent and Trademark Office*

CERTIFICATE OF CORRECTION (continued)
U.S. PAt. No. 9,878,046 B2

At Column 99, Line 21, please replace "2 as" with —2as—;

At Column 99, Line 61, please replace "Sizofurans" with —Sizofirans—;

At Column 100, Line 58, please replace "2 as" with —2as—.

In the Claims

Column 144, Lines 16-18 should read:
15. The method of claim 1, wherein the amount of glucocorticoid administered is between 0.4 and 20 mgs, inclusive.

Column 144, Line 60 to Column 145, Line 14 should read:
22. A method of ameliorating in a subject an adverse musculoskeletal effect from an administered hyaluronidase, comprising:
    a) systemically administering a hyaluronidase to the subject in an amount to treat a cancer that is a tumor, wherein:
        the hyaluronidase is a PEGylated soluble human PH20 hyaluronidase;
        the subject is human; and
        the adverse musculoskeletal effect is selected from among:
            an adverse effect that is Grade 3 or Grade 4; and
    an adverse effect that is ongoing or persistent Grade 2 toxicity that fails to resolve over a course of treatment with the hyaluronidase and that limits the ability of the subject to comply with the hyaluronidase therapy;
        the grade of the adverse musculoskeletal effect is defined by Common Terminology Criteria for Adverse Events (CTCAE) scale; and
    b) administering a sufficient amount of a glucocorticoid to the subject to ameliorate the adverse effect.

Column 145, Lines 58-61 should read:
30. The method of claim 1, wherein the human PH20 hyaluronidase is a truncated form thereof lacking a C-terminal glycosylphosphatidylinositol (GPI) attachment site or a portion of the GPI attachment site.